(12) United States Patent
Jafar-nejad

(10) Patent No.: US 11,078,486 B2
(45) Date of Patent: Aug. 3, 2021

(54) COMPOUNDS AND METHODS FOR REDUCING ATXN2 EXPRESSION

(71) Applicant: Ionis Pharmaceuticals, Inc., Carlsbad, CA (US)

(72) Inventor: Paymaan Jafar-nejad, Carlsbad, CA (US)

(73) Assignee: Ionis Pharmaceuticals, Inc., Carlsbad, CA (US)

( * ) Notice: Subject to any disclaimer, the term of this patent is extended or adjusted under 35 U.S.C. 154(b) by 0 days.

(21) Appl. No.: 16/522,133

(22) Filed: Jul. 25, 2019

(65) Prior Publication Data

US 2020/0056179 A1 Feb. 20, 2020

Related U.S. Application Data

(60) Provisional application No. 62/703,240, filed on Jul. 25, 2018.

(51) Int. Cl.
*C12N 15/113* (2010.01)
*A61K 47/02* (2006.01)
*A61K 47/46* (2006.01)

(52) U.S. Cl.
CPC ............ *C12N 15/113* (2013.01); *A61K 47/02* (2013.01); *A61K 47/46* (2013.01); *C12N 2310/14* (2013.01); *C12N 2310/315* (2013.01); *C12N 2310/322* (2013.01); *C12N 2310/341* (2013.01); *C12N 2310/346* (2013.01); *C12N 2310/351* (2013.01)

(58) Field of Classification Search
CPC .............. C12N 15/113; C12N 2310/14; C12N 2310/315; C12N 2310/322; C12N 2310/341; C12N 2310/346; C12N 2310/351
See application file for complete search history.

(56) References Cited

U.S. PATENT DOCUMENTS

| | | |
|---|---|---|
| 3,687,808 A | 8/1972 | Merigan et al. |
| 4,415,732 A | 11/1983 | Caruthers et al. |
| 4,469,863 A | 9/1984 | Ts'o et al. |
| 4,476,301 A | 10/1984 | Imbach et al. |
| 4,500,707 A | 2/1985 | Caruthers et al. |
| 4,725,677 A | 2/1988 | Koster et al. |
| 4,845,205 A | 7/1989 | Huynh Dinh et al. |
| 4,973,679 A | 11/1990 | Caruthers et al. |
| 4,981,957 A | 1/1991 | Lebleu et al. |
| 5,013,830 A | 5/1991 | Ohtsuka et al. |
| 5,023,243 A | 6/1991 | Tullis |
| 5,034,506 A | 7/1991 | Summerton et al. |
| 5,118,800 A | 6/1992 | Smith et al. |
| 5,130,302 A | 7/1992 | Spielvogel et al. |
| 5,132,418 A | 7/1992 | Caruthers et al. |
| 5,134,066 A | 7/1992 | Rogers et al. |
| RE34,036 E | 8/1992 | McGeehan |
| 5,149,797 A | 9/1992 | Pederson et al. |
| 5,166,315 A | 11/1992 | Summerton et al. |
| 5,175,273 A | 12/1992 | Bischofberger et al. |
| 5,177,196 A | 1/1993 | Meyer, Jr. et al. |
| 5,177,198 A | 1/1993 | Spielvogel et al. |
| 5,188,897 A | 2/1993 | Suhadolnik et al. |
| 5,194,599 A | 3/1993 | Froehler et al. |
| 5,214,134 A | 5/1993 | Weis et al. |
| 5,216,141 A | 6/1993 | Benner |
| 5,220,007 A | 6/1993 | Pederson et al. |
| 5,223,618 A | 6/1993 | Cook et al. |
| 5,235,033 A | 8/1993 | Summerton et al. |
| 5,256,775 A | 10/1993 | Froehler |
| 5,264,423 A | 11/1993 | Cohen et al. |
| 5,264,562 A | 11/1993 | Matteucci |
| 5,264,564 A | 11/1993 | Matteucci |
| 5,185,444 A | 12/1993 | Summerton et al. |
| 5,276,019 A | 1/1994 | Cohen et al. |
| 5,286,717 A | 2/1994 | Cohen et al. |
| 5,319,080 A | 6/1994 | Leumann |
| 5,321,131 A | 6/1994 | Agrawal et al. |
| 5,359,044 A | 10/1994 | Cook et al. |
| 5,366,878 A | 11/1994 | Pederson et al. |
| 5,367,066 A | 11/1994 | Urdea et al. |
| 5,378,825 A | 1/1995 | Cook et al. |

(Continued)

FOREIGN PATENT DOCUMENTS

| | | |
|---|---|---|
| EP | 0878543 A1 | 11/1998 |
| EP | 1752536 A1 | 2/2007 |

(Continued)

OTHER PUBLICATIONS

Albaek et al., "Analogues of a Locked Nucleic Acid with Three-Carbon 2',4'-Linkages: Aynthesis by Ring-Closing Metathesis and Influence on Nucleic Acid Duplex Stability and Structure" J. Org. Chem. (2006) 71: 7731-7740.

Ataxin-2 Wikipedia. Downloaded on Jul. 16, 2018 from http://en.wikipedia.org/wiki/Ataxin-2.

Becker et al., "Therapeutic reduction of ataxin-2 extends lifespan and reduces pathology in TDP-43 mice." Nature (2017) online Apr. 12, 2017, pp. 1-17.

Bezprozvanny et al., "Therapeutic prospects for spinocerebellar ataxia type 2 and 3." Drugs Future (2009) 34(12):1-17.

(Continued)

*Primary Examiner* — Brian Whiteman
(74) *Attorney, Agent, or Firm* — McNeill Baur PLLC

(57) ABSTRACT

Provided are compounds, methods, and pharmaceutical compositions for reducing the amount or activity of ATXN2 RNA in a cell or animal, and in certain instances reducing the amount of Ataxin-2 protein in a cell or animal. Such compounds, methods, and pharmaceutical compositions are useful to ameliorate at least one symptom or hallmark of a neurodegenerative disease. Such symptoms and hallmarks include ataxia, neuropathy, and aggregate formation. Such neurodegenerative diseases include spinocerebellar ataxia type 2 (SCA2), amyotrophic lateral sclerosis (ALS), and parkinsonism.

36 Claims, No Drawings
Specification includes a Sequence Listing.

(56) References Cited

U.S. PATENT DOCUMENTS

| | | |
|---|---|---|
| 5,386,023 A | 1/1995 | Sanghvi et al. |
| 5,393,878 A | 2/1995 | Leumann |
| 5,399,676 A | 3/1995 | Froehler |
| 5,403,711 A | 4/1995 | Walder et al. |
| 5,405,938 A | 4/1995 | Sumerton et al. |
| 5,405,939 A | 4/1995 | Suhadolnik et al. |
| 5,432,272 A | 7/1995 | Benner |
| 5,434,257 A | 7/1995 | Matteucci |
| 5,446,137 A | 8/1995 | Maag et al. |
| 5,453,496 A | 9/1995 | Caruthers et al. |
| 5,455,233 A | 10/1995 | Spielvogel et al. |
| 5,457,187 A | 10/1995 | Gmelner et al. |
| 5,457,191 A | 10/1995 | Cook et al. |
| 5,459,255 A | 10/1995 | Cook et al. |
| 5,466,677 A | 11/1995 | Baxter et al. |
| 5,466,786 A | 11/1995 | Burh et al. |
| 5,470,967 A | 11/1995 | Huie et al. |
| 5,476,925 A | 12/1995 | Letsinger et al. |
| 5,484,908 A | 1/1996 | Froehler et al. |
| 5,489,677 A | 2/1996 | Sanghvi et al. |
| 5,491,133 A | 2/1996 | Walder et al. |
| 5,502,177 A | 3/1996 | Matteucci et al. |
| 5,508,270 A | 4/1996 | Baxter et al. |
| 5,514,785 A | 5/1996 | Van Ness et al. |
| 5,519,126 A | 5/1996 | Hecht |
| 5,519,134 A | 5/1996 | Acevedo et al. |
| 5,525,711 A | 6/1996 | Hawkins et al. |
| 5,527,899 A | 6/1996 | Froehler |
| 5,536,821 A | 7/1996 | Agrawal et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,552,540 A | 9/1996 | Haralambidis |
| 5,561,225 A | 10/1996 | Maddry et al. |
| 5,563,253 A | 10/1996 | Agrawal et al. |
| 5,565,350 A | 10/1996 | Kmiec |
| 5,565,555 A | 10/1996 | Froehler et al. |
| 5,567,811 A | 10/1996 | Mistura et al. |
| 5,571,799 A | 11/1996 | Tkachuk et al. |
| 5,576,427 A | 11/1996 | Cook et al. |
| 5,587,361 A | 12/1996 | Cook et al. |
| 5,587,469 A | 12/1996 | Cook et al. |
| 5,587,470 A | 12/1996 | Cook et al. |
| 5,591,722 A | 1/1997 | Montgomery et al. |
| 5,594,121 A | 1/1997 | Froehler et al. |
| 5,596,086 A | 1/1997 | Matteucci |
| 5,596,091 A | 1/1997 | Switzer |
| 5,597,909 A | 1/1997 | Urdea et al. |
| 5,602,240 A | 2/1997 | De Mesmaeker et al. |
| 5,608,046 A | 3/1997 | Cook et al. |
| 5,610,289 A | 3/1997 | Cook et al. |
| 5,610,300 A | 3/1997 | Altmann et al. |
| 5,614,617 A | 3/1997 | Cook et al. |
| 5,618,704 A | 4/1997 | Sanghvi et al. |
| 5,623,065 A | 4/1997 | Cook et al. |
| 5,623,070 A | 4/1997 | Cook et al. |
| 5,625,050 A | 4/1997 | Beaton et al. |
| 5,627,053 A | 5/1997 | Usman et al. |
| 5,633,360 A | 5/1997 | Bishofberger et al. |
| 5,639,873 A | 6/1997 | Barascut et al. |
| 5,645,985 A | 7/1997 | Froehler et al. |
| 5,646,265 A | 7/1997 | McGee |
| 5,646,269 A | 7/1997 | Matteucci |
| 5,652,355 A | 7/1997 | Metelev et al. |
| 5,652,356 A | 7/1997 | Agrawal |
| 5,663,312 A | 9/1997 | Chaturvedula |
| 5,670,633 A | 9/1997 | Cook et al. |
| 5,672,697 A | 9/1997 | Buhr et al. |
| 5,677,437 A | 10/1997 | Teng et al. |
| 5,677,439 A | 10/1997 | Weis et al. |
| 5,681,941 A | 10/1997 | Cook et al. |
| 5,698,685 A | 12/1997 | Summerton et al. |
| 5,700,920 A | 12/1997 | Altmann et al. |
| 5,700,922 A | 12/1997 | Cook |
| 5,721,218 A | 2/1998 | Froehler |
| 5,750,692 A | 5/1998 | Cook et al. |
| 5,763,588 A | 6/1998 | Matteucci et al. |
| 5,792,608 A | 8/1998 | Swaminathan et al. |
| 5,792,847 A | 8/1998 | Burh et al. |
| 5,801,154 A | 9/1998 | Baracchini et al. |
| 5,808,027 A | 9/1998 | Cook et al. |
| 5,811,534 A | 9/1998 | Cook et al. |
| 5,830,653 A | 11/1998 | Froehler et al. |
| 5,859,221 A | 1/1999 | Cook et al. |
| 5,948,903 A | 9/1999 | Cook et al. |
| 5,994,517 A | 11/1999 | Ts'O |
| 6,005,087 A | 12/1999 | Cook et al. |
| 6,005,096 A | 12/1999 | Matteucci et al. |
| 6,166,199 A | 12/2000 | Cook et al. |
| 6,268,490 B1 | 7/2001 | Imanishi et al. |
| 6,300,319 B1 | 10/2001 | Manoharan |
| 6,426,220 B1 | 7/2002 | Bennett et al. |
| 6,525,191 B1 | 2/2003 | Ramasamy |
| 6,531,584 B1 | 3/2003 | Cook et al. |
| 6,582,908 B2 | 6/2003 | Fodor et al. |
| 6,600,032 B1 | 7/2003 | Manoharan et al. |
| 6,660,720 B2 | 12/2003 | Manoharan |
| 6,670,461 B1 | 12/2003 | Wengel et al. |
| 6,673,535 B1 | 1/2004 | Pulst |
| 6,770,748 B2 | 8/2004 | Imanishi et al. |
| 6,794,499 B2 | 9/2004 | Wengel et al. |
| 6,844,431 B1 | 1/2005 | Pulst |
| 7,015,315 B1 | 3/2006 | Cook et al. |
| 7,034,133 B2 | 4/2006 | Wengel et al. |
| 7,053,207 B2 | 5/2006 | Wengel et al. |
| 7,101,993 B1 | 9/2006 | Cook et al. |
| 7,262,177 B2 | 8/2007 | Ts'o et al. |
| 7,374,927 B2 | 5/2008 | Palma et al. |
| 7,399,845 B2 | 7/2008 | Seth et al. |
| 7,427,672 B2 | 9/2008 | Imanishi et al. |
| 7,491,805 B2 | 2/2009 | Vargeese et al. |
| 7,547,684 B2 | 6/2009 | Seth et al. |
| 7,569,686 B1 | 8/2009 | Bhat et al. |
| 7,572,582 B2 | 8/2009 | Wengel et al. |
| 7,666,854 B2 | 2/2010 | Seth et al. |
| 7,696,345 B2 | 4/2010 | Allerson et al. |
| 7,723,509 B2 | 5/2010 | Manoharan et al. |
| 7,741,457 B2 | 6/2010 | Swayze et al. |
| 7,750,131 B2 | 7/2010 | Seth et al. |
| 7,875,733 B2 | 1/2011 | Bhat et al. |
| 7,888,497 B2 | 2/2011 | Bentwich et al. |
| 7,939,677 B2 | 5/2011 | Bhat et al. |
| 8,022,193 B2 | 9/2011 | Swayze et al. |
| 8,030,467 B2 | 10/2011 | Seth et al. |
| 8,034,909 B2 | 10/2011 | Wengel et al. |
| 8,080,644 B2 | 12/2011 | Wengel et al. |
| 8,088,746 B2 | 1/2012 | Seth et al. |
| 8,088,904 B2 | 1/2012 | Swayze et al. |
| 8,106,022 B2 | 1/2012 | Manoharan et al. |
| 8,124,745 B2 | 2/2012 | Allerson et al. |
| 8,153,365 B2 | 4/2012 | Wengel et al. |
| 8,268,980 B2 | 9/2012 | Seth et al. |
| 8,278,283 B2 | 10/2012 | Seth et al. |
| 8,278,425 B2 | 10/2012 | Prakash et al. |
| 8,278,426 B2 | 10/2012 | Seth et al. |
| 8,501,805 B2 | 4/2013 | Seth et al. |
| 8,440,803 B2 | 5/2013 | Swayze et al. |
| 8,530,640 B2 | 9/2013 | Seth et al. |
| 8,546,556 B2 | 10/2013 | Seth et al. |
| RE44,779 E | 2/2014 | Imanishi et al. |
| 8,728,736 B2 | 5/2014 | Leamon et al. |
| 8,796,437 B2 | 8/2014 | Swayze et al. |
| 8,828,956 B2 | 9/2014 | Manoharan et al. |
| 9,005,906 B2 | 4/2015 | Swayze et al. |
| 9,012,421 B2 | 4/2015 | Migawa et al. |
| 9,127,276 B2 | 8/2015 | Prakash et al. |
| 9,290,760 B2 | 3/2016 | Rajeev et al. |
| 10,006,027 B2 | 6/2018 | Bennett et al. |
| 10,308,934 B2 | 6/2019 | Freier |
| 10,533,178 B2 | 1/2020 | Bennett et al. |
| 2001/0053519 A1 | 12/2001 | Fodor et al. |
| 2003/0158403 A1 | 8/2003 | Manoharan et al. |
| 2003/0175906 A1 | 9/2003 | Manoharan et al. |
| 2003/0228597 A1 | 12/2003 | Cowsert et al. |

(56) References Cited

U.S. PATENT DOCUMENTS

| | | |
|---|---|---|
| 2004/0171570 A1 | 9/2004 | Allerson et al. |
| 2004/0220132 A1 | 11/2004 | Kaemmerer |
| 2005/0026164 A1 | 2/2005 | Zhou |
| 2005/0042646 A1 | 2/2005 | Davidson et al. |
| 2005/0100885 A1 | 5/2005 | Crooke et al. |
| 2005/0130923 A1 | 6/2005 | Bhat et al. |
| 2005/0209178 A1 | 9/2005 | Pulst |
| 2005/0244851 A1 | 11/2005 | Blume et al. |
| 2005/0255487 A1 | 11/2005 | Khvorova et al. |
| 2006/0148740 A1 | 7/2006 | Platenburg |
| 2006/0270727 A1 | 11/2006 | Melander et al. |
| 2007/0031844 A1 | 2/2007 | Khvorova et al. |
| 2007/0224624 A1 | 9/2007 | Pulst |
| 2008/0039618 A1 | 2/2008 | Allerson et al. |
| 2008/0113351 A1 | 5/2008 | Naito et al. |
| 2010/0190837 A1 | 7/2010 | Migawa et al. |
| 2010/0197762 A1 | 8/2010 | Swayze et al. |
| 2011/0054005 A1 | 3/2011 | Naito et al. |
| 2011/0142789 A1 | 6/2011 | Gitler et al. |
| 2013/0130378 A1 | 5/2013 | Manoharan et al. |
| 2013/0172399 A1 | 7/2013 | Corey et al. |
| 2013/0203836 A1 | 8/2013 | Rajeev et al. |
| 2013/0225659 A1 | 8/2013 | Bennett et al. |
| 2014/0107330 A1 | 4/2014 | Freier et al. |
| 2014/0303238 A1 | 10/2014 | Linsley et al. |
| 2015/0018540 A1 | 1/2015 | Prakash et al. |
| 2015/0141320 A1 | 5/2015 | Krieg et al. |
| 2015/0184153 A1 | 7/2015 | Freier et al. |
| 2015/0191727 A1 | 7/2015 | Migawa et al. |
| 2015/0259679 A1 | 9/2015 | Bennett et al. |
| 2015/0267195 A1 | 9/2015 | Seth et al. |
| 2015/0275212 A1 | 10/2015 | Albaek et al. |
| 2016/0053254 A1 | 2/2016 | Kimpe et al. |
| 2017/0175113 A1 | 6/2017 | Bennett et al. |
| 2017/0175114 A1 | 6/2017 | Freier et al. |
| 2019/0002887 A1 | 1/2019 | Ionis Pharmaceuticals Inc |
| 2019/0017047 A1 | 1/2019 | Bennett et al. |
| 2020/0056179 A1 | 2/2020 | Freier et al. |
| 2020/0087661 A1 | 3/2020 | Freier |

FOREIGN PATENT DOCUMENTS

| | | |
|---|---|---|
| EP | 2399611 A2 | 12/2011 |
| WO | WO 2017/015555 | 1/1917 |
| WO | WO 2017/117496 | 7/1917 |
| WO | WO 2020/023737 | 1/1920 |
| WO | WO 1997/42314 | 11/1997 |
| WO | WO 1999/014226 | 3/1999 |
| WO | WO 2004/003201 | 1/2004 |
| WO | WO 2004/047872 | 6/2004 |
| WO | WO 2004/070062 | 8/2004 |
| WO | WO 2004/106356 | 12/2004 |
| WO | WO 2005/116204 | 12/2005 |
| WO | WO 2005/116212 | 12/2005 |
| WO | WO 2006/021814 | 3/2006 |
| WO | WO 2006/131925 | 12/2006 |
| WO | WO 2007/106407 | 9/2007 |
| WO | WO 2007/134181 | 11/2007 |
| WO | WO 2008/101157 | 8/2008 |
| WO | WO 2008/109379 | 9/2008 |
| WO | WO 2008/109450 | 9/2008 |
| WO | WO 2008/152636 | 12/2008 |
| WO | WO 2009/046141 | 4/2009 |
| WO | WO 2010/014592 | 2/2010 |
| WO | WO 2011/006121 | 1/2011 |
| WO | 2011073326 A2 | 6/2011 |
| WO | WO 2011/097641 | 8/2011 |
| WO | WO 2011/133876 | 10/2011 |
| WO | WO 2012/012467 | 1/2012 |
| WO | WO 2012/079578 | 6/2012 |
| WO | WO 2012/149438 | 11/2012 |
| WO | WO 2013/081864 | 6/2013 |
| WO | WO 2013/162363 | 10/2013 |
| WO | WO 2013/173645 | 11/2013 |
| WO | WO 2014/179620 | 11/2014 |
| WO | WO 2015/002971 | 1/2015 |
| WO | WO 2015/072438 | 5/2015 |
| WO | WO 2015/143245 | 9/2015 |
| WO | WO 2015/143246 | 9/2015 |

OTHER PUBLICATIONS

Braasch et al., "Novel Antisense and Peptide Nucleic Acid Strategies for Controlling Gene Expression" Biochemistry (2002) 41: 4503-4510.

Branch et al., "A good antisense molecule is hard to find," TIBS (1998) 23:45-50.

Burke et al., "Huntingtin and DRPLA proteins selectively interact with the enzyme GADPH." Nat. Med. (1996) 2(3):347-350.

Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.

Ciosk et al., "ATX-2, the C. elegans ortholog of ataxin 2, functions in translational regulation in the germline." Development (2004) 131(19):4831-4841.

Corrado et al., "ATXN-2 CAG repeat expansions are interrupted in ALS patients." Hum. Genet. (2011) 130(4):575-580.

Crooke, ST., et al., "Antisense Drug Technology" Second Edition, CRC Press (2008) Chapters 1-28.

Crooke et al., "Pharmacokinetic Properties of Several Novel Oligonucleotide Analogs in mice" J. Pharmacol. Exp. Ther. (1996) 277: 923-937.

Deleavy et al., "Designing chemically modified oligonucleotides for targeted gene silencing" Chem Biol (2012) 19(8): 937-954.

Duvick et al., "SCA1-like disease in mice expressing wild-type ataxin-1 with a serine to aspartic acid replacement at residue 776." Neuron (2010) 67(6): 929-935.

Egli, et al., "Synthesis, improved antisense activity and structural rationale for the divergent RNA affinities of 3'-fluoro hexitol nucleic acid (FHNA and Ara-FHNA) modified oligonucleotides." J Am Chem (2011) 133(41):16642-16649.

Elden et al., "Ataxin-2 intermediate-length polyglutamine expansions are associated with increased risk for ALS." Nature (2010) 466: 1069-1075.

European partial search report for 15765851.9 dated Oct. 25, 2017.
Extended Ep Search Report for 15765851.9 dated Jan. 30, 2018.

Evers et al., "Targeting Several CAG Expansion Diseases by a Single Antisense Oligonucleotide" PLoS One (2011) 6(9): e24308.

Freier et al., "The ups and downs of nucleic acid duplex stability: structure-stability studies on chemically-modified DNA:RNA duplexes" Nucleic Acids Research (1997) 25(22): 4429-4443.

Frieden et al., "Expanding the design horizon of antisense oligonucleotides with alpha-L-LNA" Nucleic Acids Research (2003) 21: 6365-6372.

Gautschi et al. "Activity of a Novel bcl-2/bcl-xL-Bispecific Antisense Oligonucleotide Against Tumors of Diverse Histologic Origins" J. Natl. Cancer Inst. (2001) 93:463-471.

GenBank: NM_002973.3, Homo sapiens ataxin 2 (ATXN2), transcript variant 1, mRNA, NCBI Accession No. NM_002973 (2015) (retrieved from the internet Jun. 28, 2017: https://www.ncbi.nlm.nih.gov/nuccore/171543894/).

GenBank: NT_009775.17 (truncated from nucleotides 2465000 to 2616000) Homo sapiens chromosome 12 genomic contig, GRCh37.p13 Primary Assembly (2013) (retrieved from the internet Jun. 28, 2017: https://www.ncbi.nlm.nih.gov/nuccore/NT_009775.17?report—genbank).

GenBank: BX410018.2, BX410018 *Homo sapiens*Fetal Brain *Homo sapiens* cDNA clone CS0DF030YB075-Prime, mRNA sequence; (2003) (retrieved from the internet Jun. 28, 2017: https://www.ncbi.nlm.nih.gov/nucest/BX410018.2).

Heuvel et al., "Taking a risk: a therapeutic focus on ataxin-2 in amyotrophic lateral sclerosis?" Trends Mol Med (2014) 20(1): 25-35.

Huynh et al., "Expression of ataxin-2 in brains from normal individuals and patients with Alzheimer's disease and spinocerebellar ataxia 2." Ann. Neurol. (1999) 45: 232-241.

(56) References Cited

OTHER PUBLICATIONS

Huynh et al., "Expansion of the polyQ repeat in ataxin-2 alters its Golgi localization, disrupts the Golgi complex and causes cell death." Hum. Mol. Genet. (2003) 12: 1485-1496.
International Search Report for application PCT/US2015/021607 dated Jun. 29, 2015.
International Search Report for application PCT/US2015/021608 dated Jul. 1, 2015.
International Search Report for application PCT/US2016/069406 dated Mar. 31, 2017.
Kabanov et al., "A new class of antivirals: antisense oligonucleotides combined with a hydrophobic substituent effectively inhibit influenza virus reproduction and synthesis of virus-specific proteins in MDCK cells" FEBS Lett. (1990) 259:327-330.
Kim et al., "Importance of low-range CAG expansion and CAA interruption in SCA2 Parkinsonism." Arch. Neurol. (2007) 64(10): 1510-1518.
Koshy et al., "Spinocerebellar ataxia type-1 and spinobulbar muscular atrophy gene products interact with glyceraldehyde-3-phosphate dehydrogenase" Hum. Mol. Genet. (1996) 5(9): 1311-1318.
Koshkin et al., "LNA 9Locked Nucleic Acids): Synthesis of the Adenine, Cytosine, Guanine, 5-Methylcytosine, Thymine and Uracil Bicyclonucleoside Monomers, Oligomerisation, and Unprecedented Nucleic Acid Recognition" Tetrahedron (1998) 54: 3607-3630.
Kumar et al., "The First Analogues of LNA (Locked Nucleic Acids): Phosphorothioate-LNA and 2'-Thio-LNA" Bioorg. Med. Chem. Lett. (1998) 8: 2219-2222.
Kumar et al., "Design, synthesis, biophysical and primer extension studies of novel acyclic butyl nucleic acid (BuNA)" Org. Biomol. Chem. (2013) 11: 5853-5865.
Lajoie et al., "Formation and toxicity of soluble polyglutamine oligomers in living cells." PLoS One (2010) 5(12): e15245 1-15.
Letsinger et al., "Cholesteryl-conjugated oligonucleotides: Synthesis, properties, and activity as inhibitors of replication of human immunodeficiency virus in cell culture" Proc. Natl. Acad. Sci. USA (1989) 86: 6553-6556.
Leumann, "DNA Analogues: From Supramolecular Principles to Biological Properties" CJ. Bioorg. & Med. Chem. (2002) 10: 841-854.
Lou Gehrig's Disease (ALS): Prevention | Florida Hospital. Downloaded on Jul. 16, 2018 from https://www.floridahospital.com/lou-gehrigs-disease-als/prevention-lou-gehrigs-disease-als.
Lovett-Racke et al., Therapeutic Potential of Small Interfering RNA for Central Nervous System Diseases. Archives of Neurobiology (2005) 62:1810-1813.
Magana et al., "Spinocerebellar ataxia type 2: clinical presentation, molecular mechanisms, and therapeutic perspectives" Mol Neurobiol (2013) 47(1): 90-104.
Maher et al., "Comparative hybrid arrest by tandem antisense oligodeoxyribonucleotides or oligodeoxyribonucleoside methylphosphonates in a cell-free system" Nuc. Acid. Res. (1988) 16(8):3341-3358.
Manoharan et al., "Chemical Modifications to Improve Uptake and Bioavailability of Antisense Oligonucleotides" Ann. N.Y. Acad. Sci. (1992) 660: 306-309.
Manoharan et al., "Introduction of a Lipophilic Thioether Tether in the Minor Groove of Nucleic Acids for Antisense Applications" Bioorg. Med. Chem. Lett. (1993) 3(12):2765-2770.
Manoharan et al., "Cholic Acid-Oligonucleotide Conjugates for Antisense Applications" Bioorg. Med. Chem. Lett. (1994) 4:1053-1060.
Manoharan et al., "Lipidic Nucleic Acids" Tetrahedron Lett. (1995) 36(21):3651-3654.
Manoharan et al., "Oligonucleotide Conjugates: Alteration of the Pharmacokinetic Properties of Antisense Agents" Nucleosides & Nucleotides (1995) 14(3-5): 969-973.

Mishra et al., "Improved leishmanicidal effect of phosphorotioate antisense oligonucleotides by LDL-mediated delivery" Biochim. Biophys. Acta (1995) 1264:229-237.
New England Biolabs 1998/99 Catalog (cover page and pp. 121 and 284).
Nishina et al., "Chimeric Antisense Oligonucleotide Conjugated to alpha-Tocopherol" Molecular Therapy Nucleic Acids (2015) 4:e220.
Nishina et al., "Efficient in Vivo Delivery of siRNA to the liver by Conjugation of alpha-Tocopherol." Molecular Therapy (2008) 16(4): 734-740.
Nonhoff et al., "Ataxin-2 interacts with the Dead/H-box RNA helicase DDX6 and interferes with P-bodies and stress granules." Mol. Biol. Cell (2007) 18(4):1385-1396.
Nonis et al., "Ataxin-2 associates with the endocytosis complex and affects EGF receptor trafficking" Cell Signal (2008) 20(10):1725-1739.
Oberhauser et al., "Effective incorporation of 2'-O-methyl-oligoribonucleotides into liposomes and enhanced cell association through modifications with thiocholesterol" Nucl. Acids Res. (1992) 20(3):533-538.
Oka et al., "An Oxazaphospholidine Approach for the Stereocontrolled Synthesis of Oligonucleoside Phosphorothioates" J. Am. Chem. Soc. (2003) 125:8307-8317.
Parkinson's Disease—Symptoms and causes—Mayo Clinic. Downnloaded on Jul. 16, 2018 from https://www.mayoclinic.org/diseases-conditions/parkinsons-disease/symptoms-causes/syc-20376055.
Pulst S.M. (ed.) "Inherited Ataxias: An Introduction" Genetics of Movement Disorders. Elsevier, Inc., Amsterdam, published Oct. 3, 2002, pp. 19-34.
Pulst S.M., "Rare mendelian diseases: pathways to therapy development" Oral presentation, American Academy of Neurology Annual Meeting, Philadelphia, PA, Apr. 29, 2014.
Ramachandran, P. "RNA interference therapy for the Spinocerebellar ataxias." Thesis, May 2014, University of Iowa, pp. 1-140.
Reynolds et al., "Rational siRNA design for RNA interference" Nature Biotechnology (2004) 22(3):326-330.
Ross et al., "Ataxin-2 repeat-length variation and neurodegeneration." Hum. Mol. Genet. (2011) 20(16): 3207-3212.
Saison-Behmoaras et al., "Short modified antisense oligonucleotides directed against Ha-ras point mutation induce selective cleavage of the mRNA and inhibit T24 cells proliferation" EMBO J. (1991) 10(5):1111-1118.
Sanghvi et al., "Heterocyclic Base Modifications in Nucleic Acids and Their Applications in Antisense Oligonucleotides" Antisense Research and Applications (1993) pp. 273-288.
Sanghvi et al., "Carbohydrate Modifications in Antisense Research" ACS Symposium Series 580; Chapters 3 and 4, 40-65.
Satterfield et al., "Ataxin-2 and its *Drosophila homolog*, ATX2, physically assemble with polyribosomes." Hum. Mol. Genet. (2006) 15(16):2523-2532.
Scoles et al., "Antisense oligonucleotides for the treatment of spinocerebellar ataxia type 2 (SCA2)" AAN Annual Meeting abstract published online Feb. 26, 2015; Neurology (2015) 82(Meeting Abstracts): S32.002.
Scoles et al., "Antisense oligonucleotide therapy for spinocerebellar ataxia type 2." Nature (2017) 544: 362-366.
Scoles et al, Antisense oligonucleotides for the treatment of spinocerebellar ataxia type 2 (SCA2), 5th Ataxia Investigators Meeting (AIM) meeting abstract presented Mar. 20, 2014.
Scoles et al., "ETS1 regulates the expression of ATXN2" Human Mol Genetics (2012) 21(23): 5048-65.
Scoles et al., "Treatment of Spinocerebellar Ataxia Type 2 (SCA2) with MOE Antisense Oligonucleotides." AAN Annual Meeting abstract published online Feb. 26, 2014; Neurology (2014) 82(10 Supplement): S47.006.
Scoles et al., "ATXN2 Is Regulated by a Promoter Associated Antisense Long Noncoding RNA (lncRNA)" Neurology (2013) 80: P05030.
Seth et al., "Short Antisense Oligonucleotides with Novel 2'-4' Conformationally Restricted Nucleoside Analogues Show Improved Potency Without Increased Toxicity in Animals " J Med Chem (2009) 52:10-13.

(56) References Cited

OTHER PUBLICATIONS

Shea et al., "Synthesis, hybridization properties and antiviral activity of lipid-oligodeoxynucleotide conjugates" Nucl. Acids Res. (1990) 18(13):3777-3783.

Shen et al., "Research on (CAG)n mutation detection of Spinocerebellar ataxia type 2" Chinese J Int Med (2000) 39(4): 259-261.

Shibata et al., "A novel protein with RNA-binding motifs interacts with ataxin-2." Hum. Mol. Genet. (2000) 9(9): 1303-1313.

Singh et al., "LNA (locked nucleic acids): synthesis and high-affinity nucleic acid recognition" Chem. Commun. (1998) 455-456.

Singh et al., "Synthesis of 2'-amino-LNA: A novel conformationally restricted high-affinity oligonucleotide analogue with a handle" J. Org. Chem. (1998) 63: 10035-10039.

Srivastava et al., "Five- and Six-Membered Conformationally Locked 2',4'-Carbocyclic ribo-Thymidines: Synthesis, Structure, and Biochemical Studies" J. Am. Chem. Soc. (2007) 129(26):8362-8379.

Svinarchuk et al., "Inhibition of HIV proliferation in MT-4 cells by antisense oligonucleotide conjugated to lipophilic groups" Biochimie (1993) 75:49-54.

Van Damme et al., "Expanded ATXN2 CAG repeat size in ALS identifies genetic overlap between ALS and SCA2." Neurology (2011) 76(24):2066-2072.

Wan et al., "Synthesis, biophysical properties and biological activity of second generation antisense oligonucleotides containing chiral phosphorothioate linkages." Nucleic Acids Research (2014) 42(22): 13456-13468.

Woolf et al. "Specificity of antisense oligonucleotides in vivo" PNAS (1992) 89:7305-7309.

Yamanaka et al., "Transcription factor sequestration by polyglutamine proteins." Methods Mol. Biol. (2010) 648:215-229.

Zhou et al., "Fine Tuning of Electrostatics around the Internucleotidic Phosphate through Incorporation of Modified 2',4'-Carbocyclic-LNAs and -ENAs Leads to Significant Modulation of Antisense Properties" J. Org. Chem. (2009) 74:118-134.

Zhang et al., "Stress Granule Assembly Disrupts Nucleocytoplasmic Transport" Cell (2018) 173:1-14.

International Search Report for application PCT/US2019/043424 dated Jan. 7, 2020.

Keiser et al., "RNAi prevents and reverses phenotypes induced by mutant human ataxin-1" Ann Neurol (2016) 80: 754-765.

Zangemeister-Wittke et al., "A novel bispecific antisense oligonucleotide inhibiting both bcl-2 and bcl-xL expression efficiently induces apoptosis in tumor cells" Clin Cancer Res (2000) 6: 2547-2555.

Elden et al., "Ataxin-2 localization in ALS and FTLD-TDP and TDP-43 localization in SCA2," Nature, 2010, 466:1069-1075 (Supplementary Information).

Chiu et al., "Age-Dependent Penetrance of Disease in a Transgenic Mouse Model of Familial Amyotrophic Lateral Sclerosis," Mol and Cell Neurosci, 1995, 6:349-362.

Frey et al., "Early and Selective Loss of Neuromuscular Synapse Subtypes with Low Sprouting Competence in Motoneuron Diseases," J Neurosci, 2000, 20(7):2534-2542.

Grunweller et al. "Comparison of different antisense strategies in mammalian cells using locked nucleic acids, 2'-O-methyl RNA, phosphorothioates and small interfering RNA" Nucl Ac Res (2003) 31: 185-193.

Gurney et al., "Motor Neuron Degeneration in Mice that Express a Human Cu,ZN Superoxide Dismutase Mutation," Science, 2004, 264:1772-1775.

Ito et al., "Treatment with edaravone, initiated at symptom onset, slows motor decline and decreases SOD1 deposition in ALS mice," Experimental Neurology, 2008, 213:448-455.

Philips et al., "Rodent Models of Amyotrophic Lateral Sclerosis," Curr Protoc Pharmacol, 2015, 69: 1-21.

Pun et al., "Selective Vulnerability and Pruning of Phasic Motoneuron Axons in Motoneuron Disease Alleviated by CTNF," Nat Neurosci, 2006, 9:408-419.

Takei et al., "Edaravone and its Clinical Development for Amyotrophic Lateral Sclerosis," Amyotrophic Lateral Sclerosis and Frontotemporal Degeneration, 2017, 18:5-10.

Van Blitterswijk et al., "Ataxin-2 as potential disease modifier in C9ORF72 expansion carriers" Neurobiology of Aging (2014) 35: e13-e17.

COMPOUNDS AND METHODS FOR REDUCING ATXN2 EXPRESSION

SEQUENCE LISTING

The present application is being filed along with a Sequence Listing in electronic format. The Sequence Listing is provided as a file entitled BIOL0321USSEQ_ST25.txt, created on Jul. 24, 2019, which is 847 KB in size. The information in the electronic format of the sequence listing is incorporated herein by reference in its entirety.

FIELD

Provided are compounds, methods, and pharmaceutical compositions for reducing the amount or activity of ATXN2 RNA in a cell or animal, and in certain instances reducing the amount of Ataxin-2 protein in a cell or animal. Such compounds, methods, and pharmaceutical compositions are useful to ameliorate at least one symptom or hallmark of a neurodegenerative disease. Such symptoms and hallmarks include ataxia, neuropathy, and aggregate formation. Such neurodegenerative diseases include spinocerebellar ataxia type 2 (SCA2), amyotrophic lateral sclerosis (ALS), and parkinsonism.

BACKGROUND

Spinocerebellar ataxia type 2 (SCA2) is an autosomal dominant neurodegenerative disease characterized by progressive functional and cell loss of neurons in the cerebellum, brain stem and spinal cord. The cause of SCA2 is CAG expansion in the ATXN2 gene resulting in polyglutamine (polyQ) expansion in the ataxin-2 protein. Patients with SCA2 are characterized by progressive cerebellar ataxia, slow saccadic eye movements and other neurologic features such as neuropathy (Pulst, S. M. (ed.), *Genetics of Movement Disorders*. Elsevier, Inc., Amsterdam, 2003, pp. 19-34.). Moderate CAG expansion in the ATXN2 gene is also associated with parkinsonism or amyotrophic lateral sclerosis (ALS) indistinguishable from the idiopathic forms of these diseases (Kim et al., *Arch. Neurol.,* 2007, 64: 1510-1518; Ross et al., *Hum. Mol. Genet.,* 2011, 20: 3207-3212; Corrado et al., *Hum. Genet.,* 2011, 130: 575-580; Elden et al., *Nature,* 2010, 466: 1069-1075; Van Damme et al., *Neurology,* 2011, 76: 2066-2072).

The pathogenic functions of polyQ disease proteins that occur with polyQ expansion may be attributed to the gain of toxicity associated with the development of intranuclear inclusion bodies or with soluble toxic oligomers (Lajoie et al., *PLoS One,* 2011, 5: e15245). While SCA2 patient brains are characterized by loss of Purkinje cells, SCA2 Purkinje cells lack inclusion bodies indicating polyQ-expanded ataxin-2 may cause toxicity that is unrelated to inclusion body formation (Huynh et al., *Ann. Neurol.,* 1999, 45: 232-241). Functions gained in polyQ-expanded ataxin-2 may include anomalous accumulation in Golgi bodies (Huynh et al., *Hum. Mol. Genet.,* 2003, 12: 1485-1496), gain-of-normal functions (Duvick et al., *Neuron,* 2010, 67: 929-935) and sequestering of transcription factors (TFs) and glyceraldehyde-3-phosphate dehydrogenase like for other polyQ proteins (Yamanaka et al., *Methods Mol. Biol.,* 2010: 648, 215-229; Koshy et al., *Hum. Mol. Genet.,* 1996, 5: 1311-1318; Burke et al., *Nat. Med.,* 1996, 2: 347-350). Some normal functions of ataxin-2 have been characterized. Ataxin-2 is present in stress granules and P-bodies suggesting functions in sequestering mRNAs and protein translation regulation during stress (Nonhoff et al., *Mol. Biol. Cell,* 2007, 18: 1385-1396). Ataxin-2 overexpression interfered with the P-body assembly, while underexpression interfered with stress granule assembly (Nonhoff et al., *Mol. Biol. Cell,* 2007, 18: 1385-1396). Interactions with polyA-binding protein 1, the RNA splicing factor A2BP1/Fox1 and polyribosomes further support roles for ataxin-2 in RNA metabolism (Shibata et al., *Hum. Mol. Genet.,* 2000, 9: 1303-1313; Ciosk et al., Development, 2004, 131: 4831-4841; Satterfield et al., *Hum. Mol. Genet.,* 2006, 15: 2523-2532). Ataxin-2 is a regulator of EGF receptor internalization and signaling by the way of its interactions with SRC kinase and the endocytic protein CIN85 (Nonis et al., *Cell Signal.,* 2008, 20: 1725-1739). Ataxin-2 also interacts with the ALS-related protein TDP-43 in an RNA-dependent manner and familial and sporadic ALS associates with the occurrence of long normal CAG repeat expansion ATXN2 (Elden et al., *Nature,* 2010, 466: 1069-1075; Van Damme et al., *Neurology,* 2011, 76: 2066-2072).

Currently there is a lack of acceptable options for treating such neurodegenerative diseases. It is therefore an object herein to provide methods for the treatment of such diseases.

SUMMARY OF THE INVENTION

Provided herein are compounds, methods, and pharmaceutical compositions for reducing the amount or activity of ATXN2 RNA, and in certain embodiments reducing the amount of Ataxin-2 protein in a cell or animal. In certain embodiments, the animal has a neurodegenerative disease. In certain embodiments, the animal has spinocerebellar ataxia type 2 (SCA2), amyotrophic lateral sclerosis (ALS), or parkinsonism. In certain embodiments, compounds useful for reducing expression of ATXN2 RNA are oligomeric compounds. In certain embodiments, the oligomeric compound comprises a modified oligonucleotide.

Also provided are methods useful for ameliorating at least one symptom or hallmark of a neurodegenerative disease. In certain embodiments, the neurodegenerative disease is SCA2, ALS, or parkinsonism. In certain embodiments symptoms and hallmarks include ataxia, neuropathy, and aggregate formation. In certain embodiments, amelioration of these symptoms results in improved motor function, reduced neuropathy, and reduction in number of aggregates.

DETAILED DESCRIPTION OF THE INVENTION

It is to be understood that both the foregoing general description and the following detailed description are exemplary and explanatory only and are not restrictive. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, and treatises, are hereby expressly incorporated-by-reference for the portions of the document discussed herein, as well as in their entirety.

DEFINITIONS

Unless specific definitions are provided, the nomenclature used in connection with, and the procedures and techniques of, analytical chemistry, synthetic organic chemistry, and medicinal and pharmaceutical chemistry described herein are those well known and commonly used in the art. Where permitted, all patents, applications, published applications and other publications and other data referred to throughout in the disclosure are incorporated by reference herein in their entirety.

Unless otherwise indicated, the following terms have the following meanings:

As used herein, "2'-deoxynucleoside" means a nucleoside comprising a 2'-H(H) deoxyribosy sugar moiety, as found in naturally occurring deoxyribonucleic acids (DNA). In certain embodiments, a 2'-deoxynucleoside may comprise a modified nucleobase or may comprise an RNA nucleobase (uracil).

As used herein, "2'-substituted nucleoside" means a nucleoside comprising a 2'-substituted sugar moiety. As used herein, "2'-substituted" in reference to a sugar moiety means a sugar moiety comprising at least one 2'-substituent group other than H or OH.

As used herein, "5-methyl cytosine" means a cytosine modified with a methyl group attached to the 5 position. A 5-methyl cytosine is a modified nucleobase.

As used herein, "administering" means providing a pharmaceutical agent to an animal.

As used herein, "animal" means a human or non-human animal.

As used herein, "antisense activity" means any detectable and/or measurable change attributable to the hybridization of an antisense compound to its target nucleic acid. In certain embodiments, antisense activity is a decrease in the amount or expression of a target nucleic acid or protein encoded by such target nucleic acid compared to target nucleic acid levels or target protein levels in the absence of the antisense compound.

As used herein, "antisense compound" means an oligomeric compound capable of achieving at least one antisense activity.

As used herein, "ameliorate" in reference to a treatment means improvement in at least one symptom relative to the same symptom in the absence of the treatment. In certain embodiments, amelioration is the reduction in the severity or frequency of a symptom or the delayed onset or slowing of progression in the severity or frequency of a symptom. In certain embodiments, the symptom or hallmark is ataxia, neuropathy, and aggregate formation. In certain embodiments, amelioration of these symptoms results in improved motor function, reduced neuropathy, or reduction in number of aggregates.

As used herein, "bicyclic nucleoside" or "BNA" means a nucleoside comprising a bicyclic sugar moiety.

As used herein, "bicyclic sugar" or "bicyclic sugar moiety" means a modified sugar moiety comprising two rings, wherein the second ring is formed via a bridge connecting two of the atoms in the first ring thereby forming a bicyclic structure. In certain embodiments, the first ring of the bicyclic sugar moiety is a furanosyl moiety. In certain embodiments, the bicyclic sugar moiety does not comprise a furanosyl moiety.

As used herein, "cleavable moiety" means a bond or group of atoms that is cleaved under physiological conditions, for example, inside a cell, an animal, or a human.

As used herein, "complementary" in reference to an oligonucleotide means that at least 70% of the nucleobases of the oligonucleotide or one or more regions thereof and the nucleobases of another nucleic acid or one or more regions thereof are capable of hydrogen bonding with one another when the nucleobase sequence of the oligonucleotide and the other nucleic acid are aligned in opposing directions. Complementary nucleobases means nucleobases that are capable of forming hydrogen bonds with one another. Complementary nucleobase pairs include adenine (A) and thymine (T), adenine (A) and uracil (U), cytosine (C) and guanine (G), 5-methyl cytosine (mC) and guanine (G). Complementary oligonucleotides and/or nucleic acids need not have nucleobase complementarity at each nucleoside. Rather, some mismatches are tolerated. As used herein, "fully complementary" or "100% complementary" in reference to oligonucleotides means that oligonucleotides are complementary to another oligonucleotide or nucleic acid at each nucleoside of the oligonucleotide.

As used herein, "conjugate group" means a group of atoms that is directly attached to an oligonucleotide. Conjugate groups include a conjugate moiety and a conjugate linker that attaches the conjugate moiety to the oligonucleotide.

As used herein, "conjugate linker" means a single bond or a group of atoms comprising at least one bond that connects a conjugate moiety to an oligonucleotide.

As used herein, "conjugate moiety" means a group of atoms that is attached to an oligonucleotide via a conjugate linker.

As used herein, "contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other in a sequence.

As used herein, "constrained ethyl" or "cEt" or "cEt modified sugar" means a β-D ribosyl bicyclic sugar moiety wherein the second ring of the bicyclic sugar is formed via a bridge connecting the 4'-carbon and the 2'-carbon of the β-D ribosyl sugar moiety, wherein the bridge has the formula 4'-CH(CH$_3$)—O-2', and wherein the methyl group of the bridge is in the S configuration.

As used herein, "cEt nucleoside" means a nucleoside comprising cEt modified sugar.

As used herein, "chirally enriched population" means a plurality of molecules of identical molecular formula, wherein the number or percentage of molecules within the population that contain a particular stereochemical configuration at a particular chiral center is greater than the number or percentage of molecules expected to contain the same particular stereochemical configuration at the same particular chiral center within the population if the particular chiral center were stereorandom. Chirally enriched populations of molecules having multiple chiral centers within each molecule may contain one or more stereorandom chiral centers. In certain embodiments, the molecules are modified oligonucleotides. In certain embodiments, the molecules are compounds comprising modified oligonucleotides.

As used herein, "gapmer" means a modified oligonucleotide comprising an internal region having a plurality of nucleosides that support RNase H cleavage positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings." Unless otherwise indicated, "gapmer" refers to a sugar motif. Unless otherwise indicated, the sugar moieties of the nucleosides of the gap of a gapmer are unmodified 2'-deoxyribosyl. Thus, the term "MOE gapmer" indicates a gapmer having a sugar motif of 2'-MOE nucleosides in both wings and a gap of 2'-deoxynucleosides. Unless otherwise indicated, a MOE gapmer may comprise one or more modified internucleoside linkages and/or modified nucleobases and such modifications do not necessarily follow the gapmer pattern of the sugar modifications.

As used herein, "hotspot region" is a range of nucleobases on a target nucleic acid amenable to oligomeric compound-mediated reduction of the amount or activity of the target nucleic acid.

As used herein, "hybridization" means the pairing or annealing of complementary oligonucleotides and/or nucleic acids. While not limited to a particular mechanism, the most common mechanism of hybridization involves hydrogen bonding, which may be Watson-Crick, Hoogsteen or reversed Hoogsteen hydrogen bonding, between complementary nucleobases.

As used herein, the term "internucleoside linkage" is the covalent linkage between adjacent nucleosides in an oligonucleotide. As used herein "modified internucleoside linkage" means any internucleoside linkage other than a phosphodiester internucleoside linkage. "Phosphorothioate internucleoside linkage" is a modified internucleoside linkage in which one of the non-bridging oxygen atoms of a phosphodiester internucleoside linkage is replaced with a sulfur atom.

As used herein, "linker-nucleoside" means a nucleoside that links, either directly or indirectly, an oligonucleotide to a conjugate moiety. Linker-nucleosides are located within the conjugate linker of an oligomeric compound. Linker-nucleosides are not considered part of the oligonucleotide portion of an oligomeric compound even if they are contiguous with the oligonucleotide.

As used herein, "non-bicyclic modified sugar moiety" means a modified sugar moiety that comprises a modification, such as a substituent, that does not form a bridge between two atoms of the sugar to form a second ring.

As used herein, "mismatch" or "non-complementary" means a nucleobase of a first oligonucleotide that is not complementary with the corresponding nucleobase of a second oligonucleotide or target nucleic acid when the first and second oligonucleotide are aligned.

As used herein, "MOE" means methoxyethyl. "2'-MOE" or "2'-MOE modified sugar" means a 2'-OCH$_2$CH$_2$OCH$_3$ group in place of the 2'-OH group of a ribosyl sugar moiety. As used herein, "2'-MOE nucleoside" means a nucleoside comprising a 2'-MOE modified sugar.

As used herein, "motif" means the pattern of unmodified and/or modified sugar moieties, nucleobases, and/or internucleoside linkages, in an oligonucleotide.

As used herein, "neurodegenerative disease" means a condition marked by progressive loss of function or structure, including loss of motor function and death of neurons. In certain embodiments, the neurodegenerative disease is spinocerebellar ataxia type 2 (SCA2), amyotrophic lateral sclerosis (ALS), or parkinsonism.

As used herein, "nucleobase" means an unmodified nucleobase or a modified nucleobase. As used herein an "unmodified nucleobase" is adenine (A), thymine (T), cytosine (C), uracil (U), or guanine (G). As used herein, a "modified nucleobase" is a group of atoms other than unmodified A, T, C, U, or G capable of pairing with at least one unmodified nucleobase. A "5-methyl cytosine" is a modified nucleobase. A universal base is a modified nucleobase that can pair with any one of the five unmodified nucleobases. As used herein, "nucleobase sequence" means the order of contiguous nucleobases in a nucleic acid or oligonucleotide independent of any sugar or internucleoside linkage modification.

As used herein, "nucleoside" means a compound comprising a nucleobase and a sugar moiety. The nucleobase and sugar moiety are each, independently, unmodified or modified. As used herein, "modified nucleoside" means a nucleoside comprising a modified nucleobase and/or a modified sugar moiety. Modified nucleosides include abasic nucleosides, which lack a nucleobase. "Linked nucleosides" are nucleosides that are connected in a contiguous sequence (i.e., no additional nucleosides are presented between those that are linked).

As used herein, "oligomeric compound" means an oligonucleotide and optionally one or more additional features, such as a conjugate group or terminal group. An oligomeric compound may be paired with a second oligomeric compound that is complementary to the first oligomeric compound or may be unpaired. A "singled-stranded oligomeric compound" is an unpaired oligomeric compound. The term "oligomeric duplex" means a duplex formed by two oligomeric compounds having complementary nucleobase sequences. Each oligomeric compound of an oligomeric duplex may be referred to as a "duplexed oligomeric compound."

As used herein, "oligonucleotide" means a strand of linked nucleosides connected via internucleoside linkages, wherein each nucleoside and internucleoside linkage may be modified or unmodified. Unless otherwise indicated, oligonucleotides consist of 8-50 linked nucleosides. As used herein, "modified oligonucleotide" means an oligonucleotide, wherein at least one nucleoside or internucleoside linkage is modified. As used herein, "unmodified oligonucleotide" means an oligonucleotide that does not comprise any nucleoside modifications or internucleoside modifications.

As used herein, "pharmaceutically acceptable carrier or diluent" means any substance suitable for use in administering to an animal. Certain such carriers enable pharmaceutical compositions to be formulated as, for example, tablets, pills, dragees, capsules, liquids, gels, syrups, slurries, suspension and lozenges for the oral ingestion by a subject. In certain embodiments, a pharmaceutically acceptable carrier or diluent is sterile water, sterile saline, sterile buffer solution or sterile artificial cerebrospinal fluid.

As used herein "pharmaceutically acceptable salts" means physiologically and pharmaceutically acceptable salts of compounds. Pharmaceutically acceptable salts retain the desired biological activity of the parent compound and do not impart undesired toxicological effects thereto.

As used herein "pharmaceutical composition" means a mixture of substances suitable for administering to a subject. For example, a pharmaceutical composition may comprise an oligomeric compound and a sterile aqueous solution. In certain embodiments, a pharmaceutical composition shows activity in free uptake assay in certain cell lines.

As used herein "prodrug" means a therapeutic agent in a form outside the body that is converted to a different form within an animal or cells thereof. Typically conversion of a prodrug within the animal is facilitated by the action of an enzymes (e.g., endogenous or viral enzyme) or chemicals present in cells or tissues and/or by physiologic conditions.

As used herein, "reducing or inhibiting the amount or activity" refers to a reduction or blockade of the transcriptional expression or activity relative to the transcriptional expression or activity in an untreated or control sample and does not necessarily indicate a total elimination of transcriptional expression or activity.

As used herein, "RNAi compound" means an antisense compound that acts, at least in part, through RISC or Ago2 to modulate a target nucleic acid and/or protein encoded by a target nucleic acid. RNAi compounds include, but are not limited to double-stranded siRNA, single-stranded RNA (ssRNA), and microRNA, including microRNA mimics. In certain embodiments, an RNAi compound modulates the amount, activity, and/or splicing of a target nucleic acid. The term RNAi compound excludes antisense compounds that act through RNase H.

As used herein, "self-complementary" in reference to an oligonucleotide means an oligonucleotide that at least partially hybridizes to itself.

As used herein, "standard cell assay" means the assay described in Example 3 and reasonable variations thereof.

As used herein, "standard in vivo assay" means the experiment described in Example 15 and reasonable variations thereof.

As used herein, "stereorandom chiral center" in the context of a population of molecules of identical molecular formula means a chiral center having a random stereochemical configuration. For example, in a population of molecules comprising a stereorandom chiral center, the number of molecules having the (S) configuration of the stereorandom chiral center may be but is not necessarily the same as the number of molecules having the (R) configuration of the stereorandom chiral center. The stereochemical configuration of a chiral center is considered random when it is the results of a synthetic method that is not designed to control the stereochemical configuration. In certain embodiments, a stereorandom chiral center is a stereorandom phosphorothioate internucleoside linkage.

As used herein, "sugar moiety" means an unmodified sugar moiety or a modified sugar moiety. As used herein, "unmodified sugar moiety" means a 2'-OH(H) ribosyl moiety, as found in RNA (an "unmodified RNA sugar moiety"), or a 2'-H(H) deoxyribosyl moiety, as found in DNA (an "unmodified DNA sugar moiety"). Unmodified sugar moieties have one hydrogen at each of the 1', 3', and 4' positions, an oxygen at the 3' position, and two hydrogens at the 5' position. As used herein, "modified sugar moiety" or "modified sugar" means a modified furanosyl sugar moiety or a sugar surrogate.

As used herein, "sugar surrogate" means a modified sugar moiety having other than a furanosyl moiety that can link a nucleobase to another group, such as an internucleoside linkage, conjugate group, or terminal group in an oligonucleotide. Modified nucleosides comprising sugar surrogates can be incorporated into one or more positions within an oligonucleotide and such oligonucleotides are capable of hybridizing to complementary oligomeric compounds or target nucleic acids.

As used herein, "target nucleic acid" and "target RNA" mean a nucleic acid that an antisense compound is designed to affect.

As used herein, "target region" means a portion of a target nucleic acid to which an oligomeric compound is designed to hybridize.

As used herein, "terminal group" means a chemical group or group of atoms that is covalently linked to a terminus of an oligonucleotide.

As used herein, "therapeutically effective amount" means an amount of a pharmaceutical agent that provides a therapeutic benefit to an animal. For example, a therapeutically effective amount improves a symptom of a disease.

CERTAIN EMBODIMENTS

The present disclosure provides the following non-limiting numbered embodiments:

Embodiment 1

An oligomeric compound, comprising a modified oligonucleotide consisting of 12-50 linked nucleosides wherein the nucleobase sequence of the modified oligonucleotide is at least 90% complementary to an equal length portion of an ATXN2 nucleic acid, and wherein the modified oligonucleotide comprises at least one modification selected from a modified sugar, a sugar surrogate, and a modified internucleoside linkage.

Embodiment 2

An oligomeric compound comprising a modified oligonucleotide consisting of 12-50 linked nucleosides and having a nucleobase sequence comprising at least 12, at least 13, at least 14, at least 15, at least 16, at least 17, at least 18, at least 19, or at least 20 contiguous nucleobases of any of the nucleobase sequences of SEQ ID NOS: 30-3319.

Embodiment 3

An oligomeric compound comprising a modified oligonucleotide consisting of 12-50 linked nucleosides and having a nucleobase sequence comprising a portion of at least 8, at least 9, at least 10, at least 11, at least 12, at least 13, at least 14, at least 15, at least 16, at least 17, at least 18, at least 19, or at least 20 contiguous nucleobases, wherein the portion is complementary to:

an equal length portion of nucleobases 2,455-2,483 of SEQ ID NO: 1;
an equal length portion of nucleobases 4,393-4,424 of SEQ ID NO: 1;
an equal length portion of nucleobases 4,413-4,437 of SEQ ID NO: 1;
an equal length portion of nucleobases 4,525-4,554 of SEQ ID NO: 2;
an equal length portion of nucleobases 4,748-4,771 of SEQ ID NO: 2;
an equal length portion of nucleobases 9,927-9,954 of SEQ ID NO: 2;
an equal length portion of nucleobases 10,345-10,368 of SEQ ID NO: 2;
an equal length portion of nucleobases 17,153-17,182 of SEQ ID NO: 2;
an equal length portion of nucleobases 18,680-18,702 of SEQ ID NO: 2;
an equal length portion of nucleobases 23,251-23,276 of SEQ ID NO: 2;
an equal length portion of nucleobases 28,081-28,105 of SEQ ID NO: 2;
an equal length portion of nucleobases 28,491-28,526 of SEQ ID NO: 2;

an equal length portion of nucleobases 28,885-28,912 of SEQ ID NO: 2;

an equal length portion of nucleobases 32,328-32,352 of SEQ ID NO: 2;

an equal length portion of nucleobases 32,796-32,824 of SEQ ID NO: 2;

an equal length portion of nucleobases 32,809-32,838 of SEQ ID NO: 2;

an equal length portion of nucleobases 36,308-36,334 of SEQ ID NO: 2;

an equal length portion of nucleobases 36,845-36,872 of SEQ ID NO: 2;

an equal length portion of nucleobases 49,147-49,173 of SEQ ID NO: 2;

an equal length portion of nucleobases 57,469-57,494 of SEQ ID NO: 2;

an equal length portion of nucleobases 82,848-82,874 of SEQ ID NO: 2;

an equal length portion of nucleobases 83,784-83,813 of SEQ ID NO: 2;

an equal length portion of nucleobases 84,743-84,782 of SEQ ID NO: 2;

an equal length portion of nucleobases 84,813-84,839 of SEQ ID NO: 2;

an equal length portion of nucleobases 85,051-85,076 of SEQ ID NO: 2;

an equal length portion of nucleobases 97,618-97,643 of SEQ ID NO: 2;

an equal length portion of nucleobases 119,023-119,048 of SEQ ID NO: 2;

an equal length portion of nucleobases 132,161-132,195 of SEQ ID NO: 2;

an equal length portion of nucleobases 139,271-139,303 of SEQ ID NO: 2; or an equal length portion of nucleobases 1,075-1,146 of SEQ ID NO: 1.

Embodiment 4

The oligomeric compound of any one of embodiments 1-3, wherein the modified oligonucleotide has a nucleobase sequence that is at least 80%, at least 85%, at least 90%, at least 95%, or 100% complementary to any of the nucleobase sequences of SEQ ID NO: 1 or SEQ ID NO: 2, when measured across the entire nucleobase sequence of the modified oligonucleotide.

Embodiment 5

The oligomeric compound of any of embodiments 1-4, wherein the modified oligonucleotide comprises at least one modified nucleoside.

Embodiment 6

The oligomeric compound of embodiment 5, wherein the modified oligonucleotide comprises at least one modified nucleoside comprising a modified sugar moiety.

Embodiment 7

The oligomeric compound of embodiment 6, wherein the modified oligonucleotide comprises at least one modified nucleoside comprising a bicyclic sugar moiety.

Embodiment 8

The oligomeric compound of embodiment 7, wherein the modified oligonucleotide comprises at least one modified nucleoside comprising a bicyclic sugar moiety having a 2'-4' bridge, wherein the 2'-4' bridge is selected from —O—CH2-; and —O—CH(CH3)—.

Embodiment 9

The oligomeric compound of any of embodiments 5-8, wherein the modified oligonucleotide comprises at least one modified nucleoside comprising a non-bicyclic modified sugar moiety.

Embodiment 10

The oligomeric compound of embodiment 9, wherein the modified oligonucleotide comprises at least one modified nucleoside comprising a non-bicyclic modified sugar moiety comprising a 2'-MOE modified sugar or 2'-OMe modified sugar.

Embodiment 11

The oligomeric compound of any of embodiments 5-10, wherein the modified oligonucleotide comprises at least one modified nucleoside comprising a sugar surrogate.

Embodiment 12

The oligomeric compound of embodiment 11, wherein the modified oligonucleotide comprises at least one modified nucleoside comprising a sugar surrogate selected from morpholino and PNA.

Embodiment 13

The oligomeric compound of any of embodiments 1-12, wherein the modified oligonucleotide has a sugar motif comprising:

a 5'-region consisting of 1-5 linked 5'-region nucleosides;

a central region consisting of 6-10 linked central region nucleosides; and a 3'-region consisting of 1-5 linked 3'-region nucleosides; wherein each of the 5'-region nucleosides and each of the 3'-region nucleosides comprises a modified sugar moiety and each of the central region nucleosides comprises an unmodified 2'-deoxyribosyl sugar moiety.

Embodiment 14

The oligomeric compound of any of embodiments 1-13, wherein the modified oligonucleotide comprises at least one modified internucleoside linkage.

Embodiment 15

The oligomeric compound of embodiment 14, wherein each internucleoside linkage of the modified oligonucleotide is a modified internucleoside linkage.

Embodiment 16

The oligomeric compound of embodiment 14 or 15 wherein at least one internucleoside linkage is a phosphorothioate internucleoside linkage.

Embodiment 17

The oligomeric compound of embodiment 14 or 16 wherein the modified oligonucleotide comprises at least one phosphodiester internucleoside linkage.

Embodiment 18

The oligomeric compound of any of embodiments 14, 16, or 17, wherein each internucleoside linkage is either a phosphodiester internucleoside linkage or a phosphorothioate internucleoside linkage.

Embodiment 19

The oligomeric compound of any of embodiments 1-18, wherein the modified oligonucleotide comprises at least one modified nucleobase.

Embodiment 20

The oligomeric compound of embodiment 19, wherein the modified nucleobase is a 5-methyl cytosine.

Embodiment 21

The oligomeric compound of any of embodiments 1-20, wherein the modified oligonucleotide consists of 12-30, 12-22, 12-20, 14-20, 15-25, 16-20, 18-22 or 18-20 linked nucleosides.

Embodiment 22

The oligomeric compound of any of embodiments 1-21, wherein the modified oligonucleotide consists of 18 or 20 linked nucleosides.

Embodiment 23

The oligomeric compound of any of embodiments 1-22 consisting of the modified oligonucleotide.

Embodiment 24

The oligomeric compound of any of embodiments 1-22 comprising a conjugate group comprising a conjugate moiety and a conjugate linker.

Embodiment 25

The oligomeric compound of embodiment 24, wherein the conjugate group comprises a GalNAc cluster comprising 1-3 GalNAc ligands.

Embodiment 26

The oligomeric compound of embodiment 24 or 25, wherein the conjugate linker consists of a single bond.

Embodiment 27

The oligomeric compound of embodiment 25, wherein the conjugate linker is cleavable.

Embodiment 28

The oligomeric compound of embodiment 27, wherein the conjugate linker comprises 1-3 linker-nucleosides.

Embodiment 29

The oligomeric compound of any of embodiments 24-28, wherein the conjugate group is attached to the modified oligonucleotide at the 5'-end of the modified oligonucleotide.

Embodiment 30

The oligomeric compound of any of embodiments 24-28, wherein the conjugate group is attached to the modified oligonucleotide at the 3'-end of the modified oligonucleotide.

Embodiment 31

The oligomeric compound of any of embodiments 1-30 comprising a terminal group.

Embodiment 32

The oligomeric compound of any of embodiments 1-31 wherein the oligomeric compound is a singled-stranded oligomeric compound.

Embodiment 33

The oligomeric compound of any of embodiments 1-27 or 29-31, wherein the oligomeric compound does not comprise linker-nucleosides.

Embodiment 34

An oligomeric duplex comprising an oligomeric compound of any of embodiments 1-31 or 33.

Embodiment 35

An antisense compound comprising or consisting of an oligomeric compound of any of embodiments 1-33 or an oligomeric duplex of embodiment 34.

Embodiment 36

A pharmaceutical composition comprising an oligomeric compound of any of embodiments 1-33 or an oligomeric duplex of embodiment 34 and a pharmaceutically acceptable carrier or diluent.

Embodiment 37
A modified oligonucleotide according to the following formula:
(SEQ ID NO: 1714)
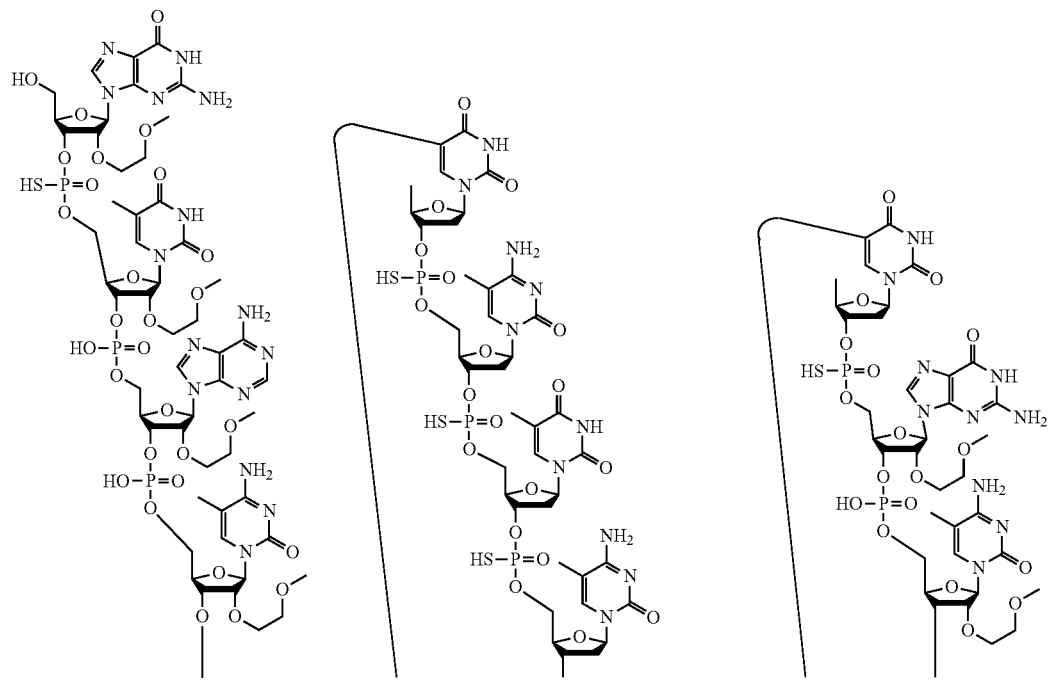
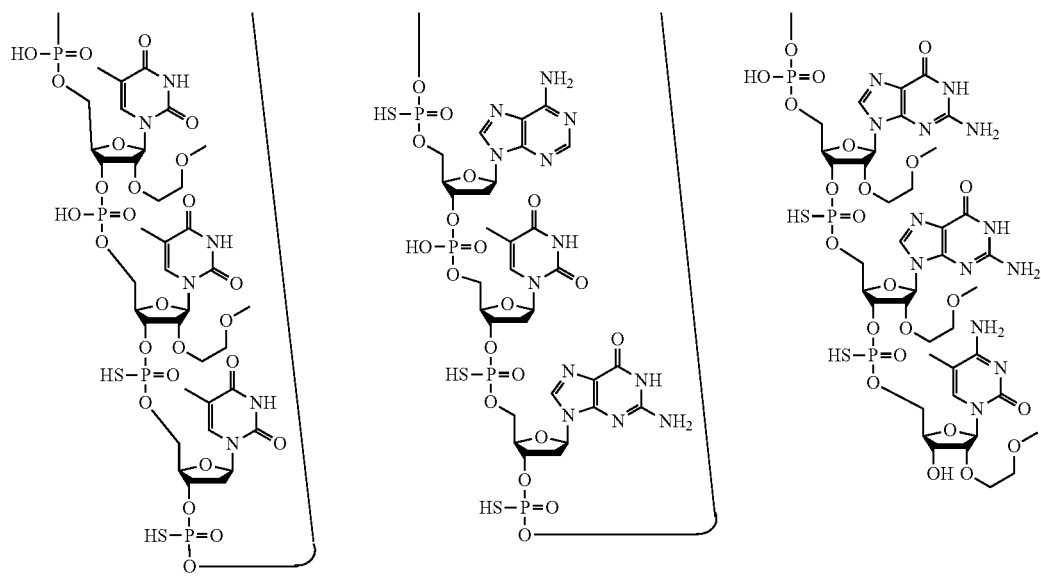
or a salt thereof.

Embodiment 38
A modified oligonucleotide according to the following formula:
(SEQ ID NO: 1255)
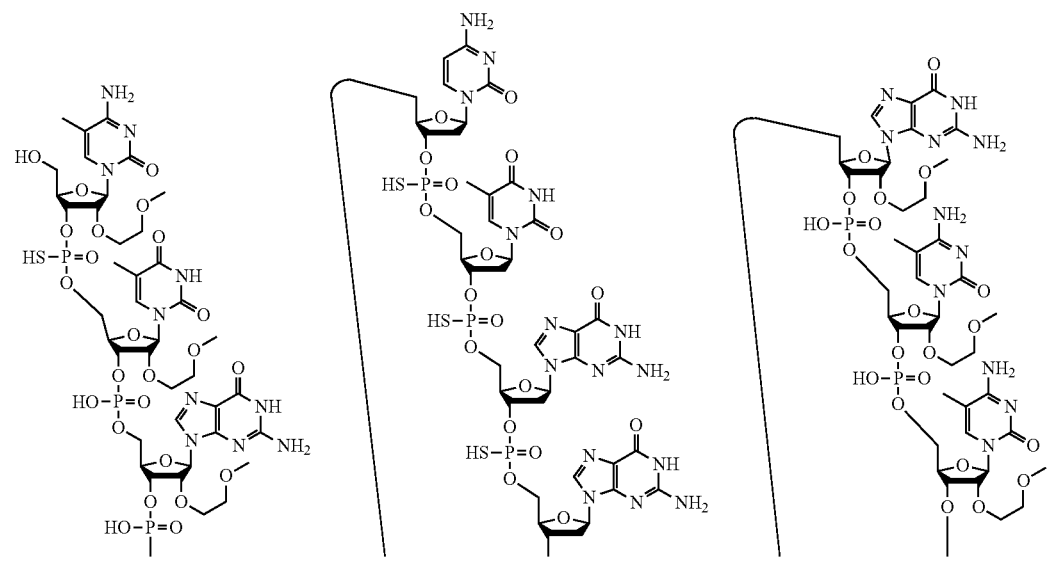
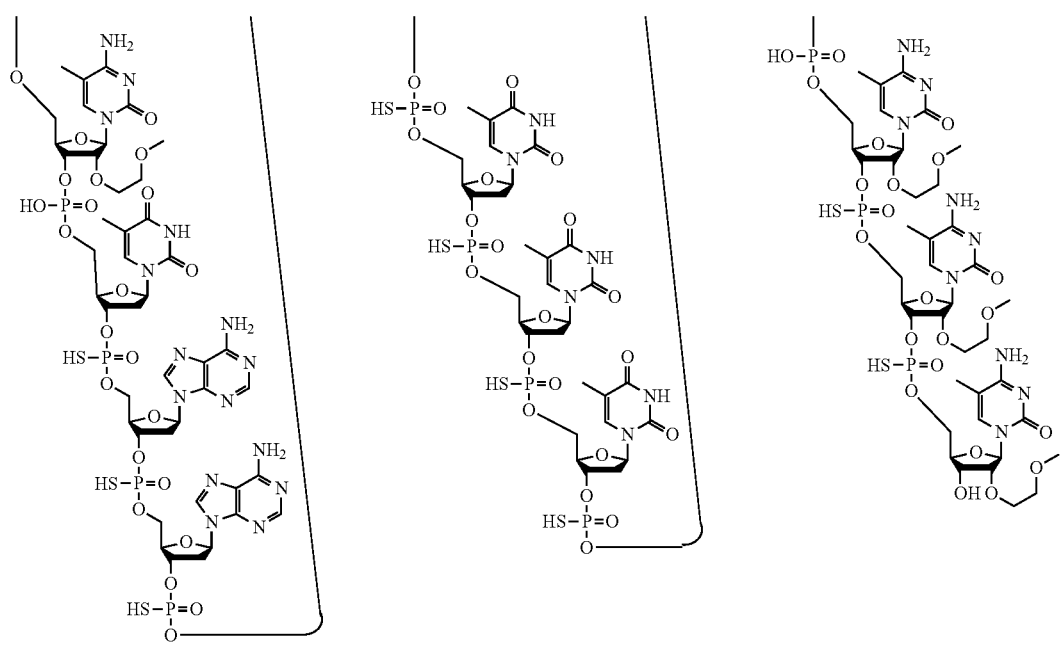
or a salt thereof.

Embodiment 39
A modified oligonucleotide according to the following formula:
(SEQ ID NO: 1185)
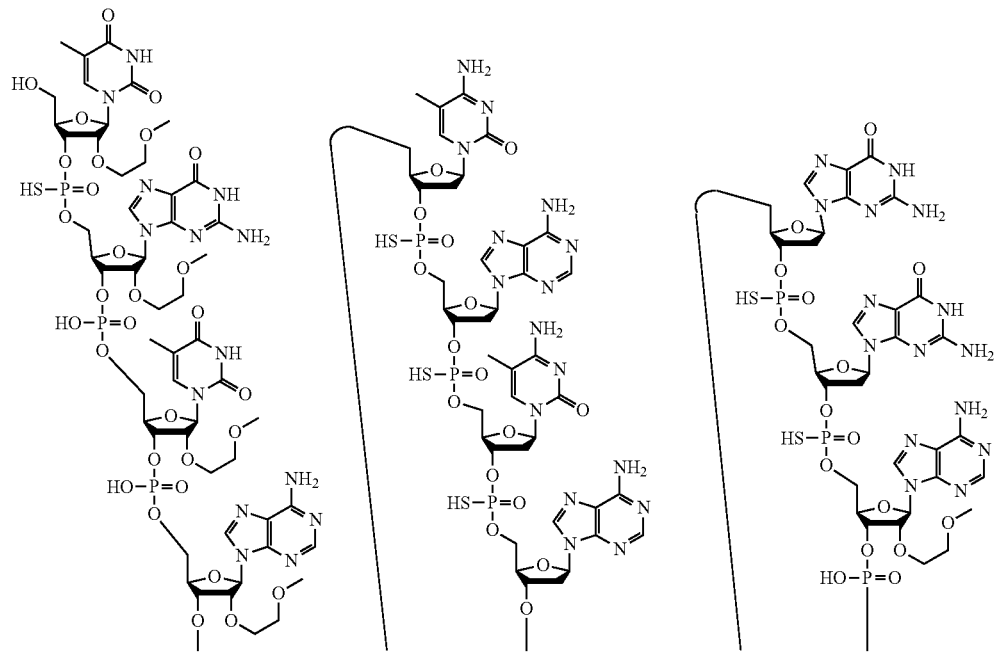
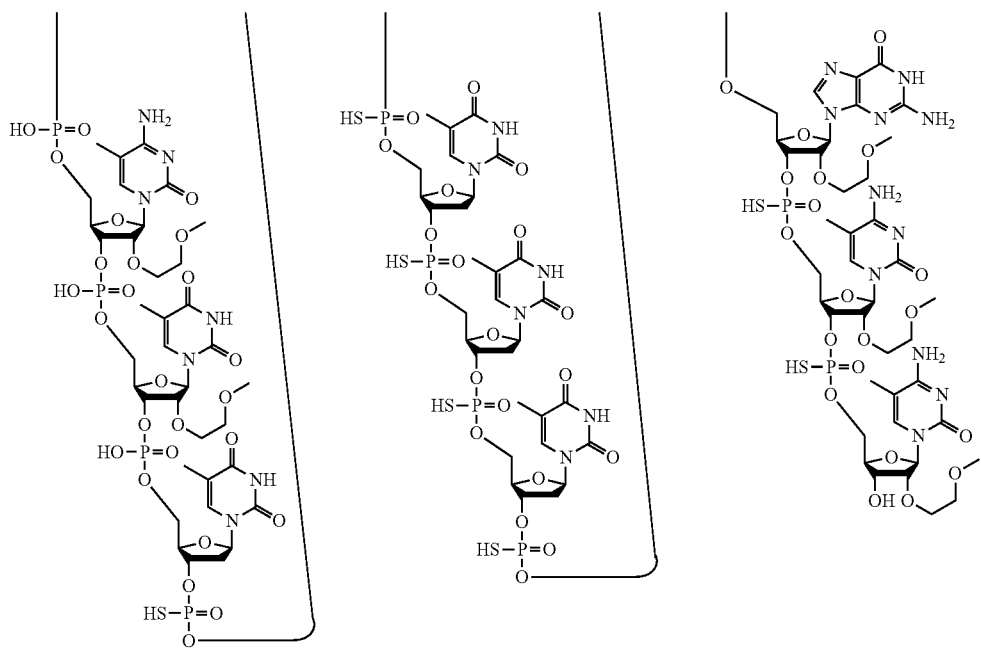
or a salt thereof.

Embodiment 40
A modified oligonucleotide according to the following formula:
(SEQ ID NO: 3235)
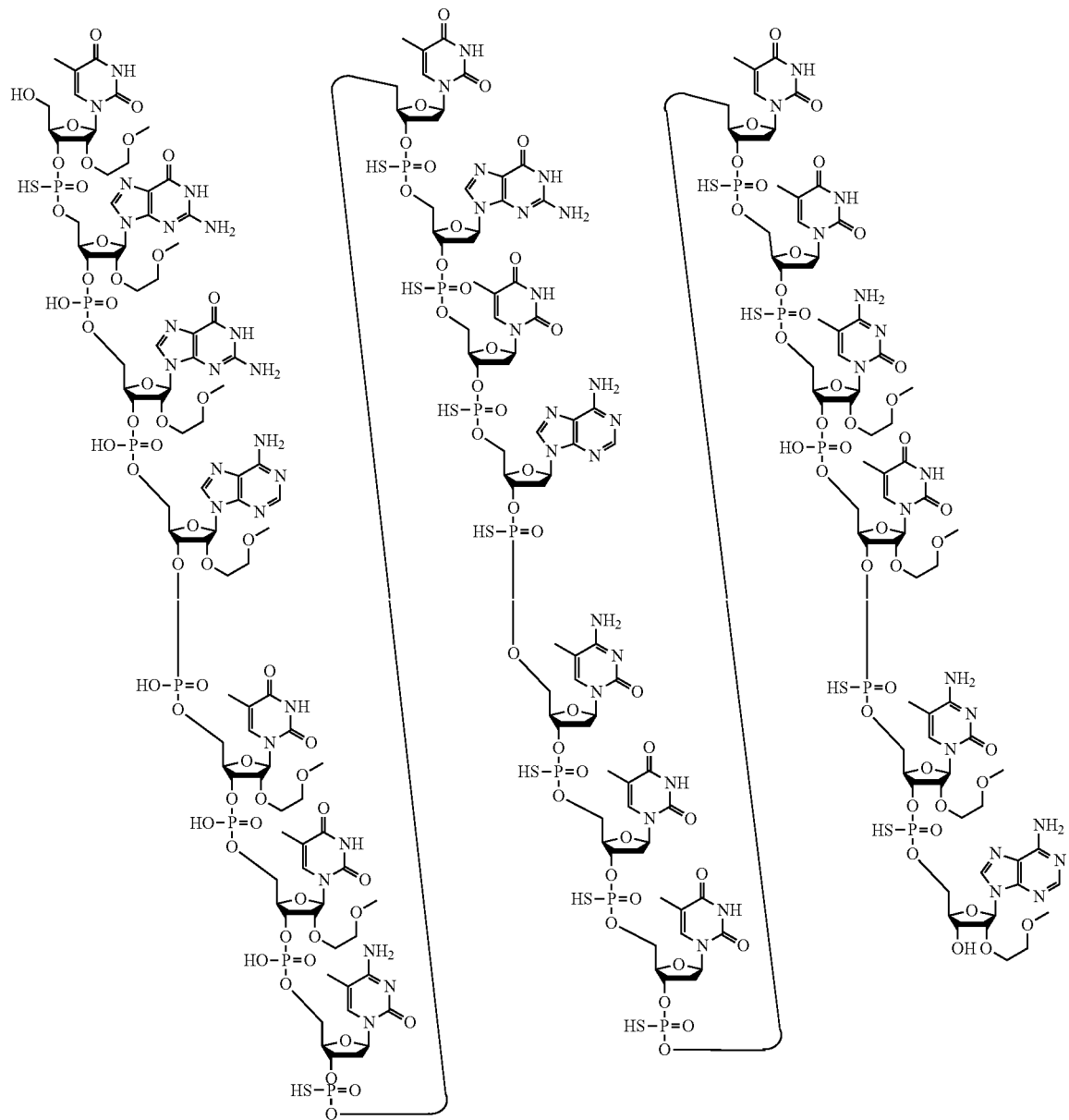
or a salt thereof.
Embodiment 41
A modified oligonucleotide according to the following formula:

(SEQ ID NO: 158)
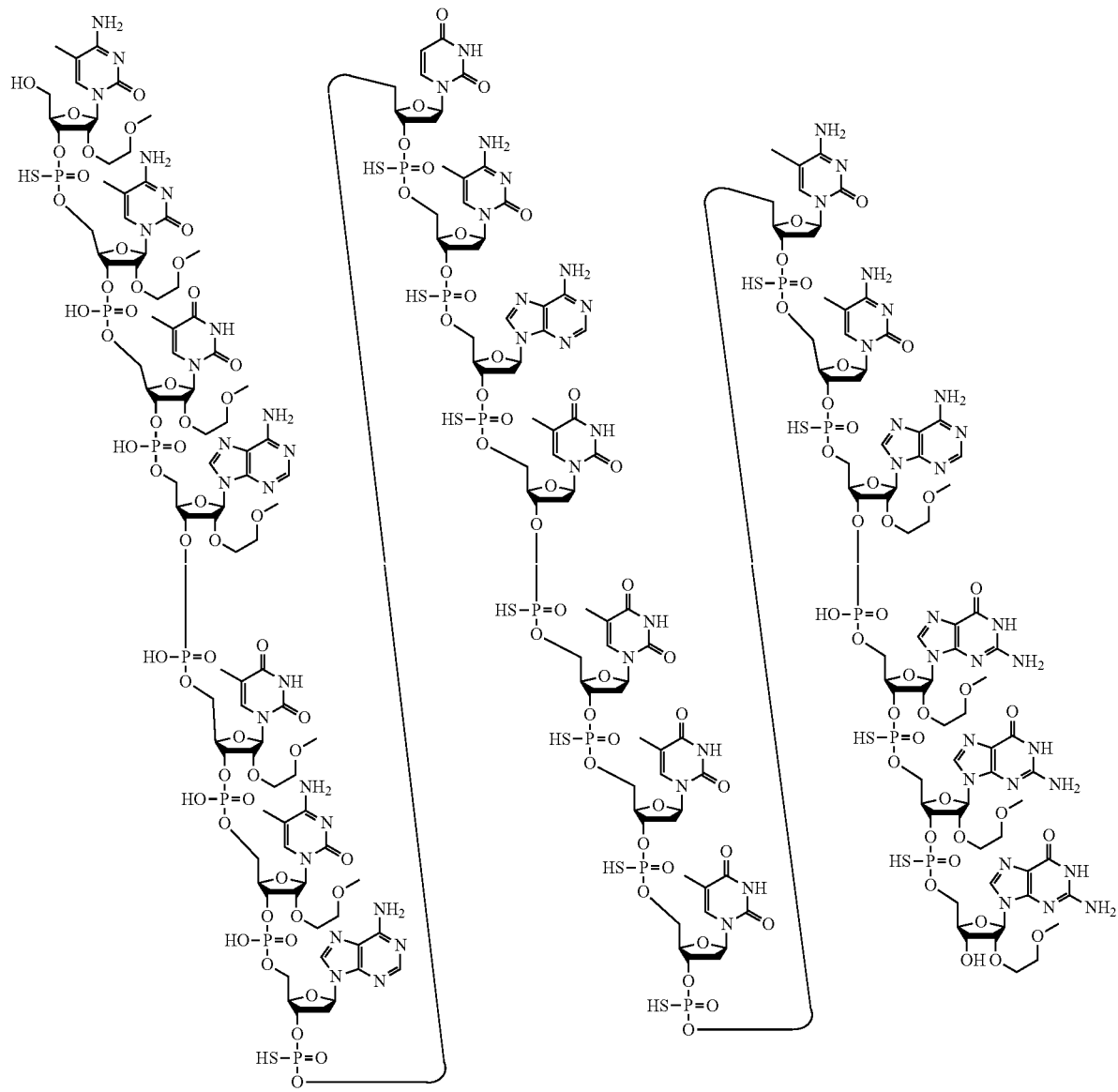
or a salt thereof.
Embodiment 42
A modified oligonucleotide according to the following formula:

SEQ ID NO: 2544
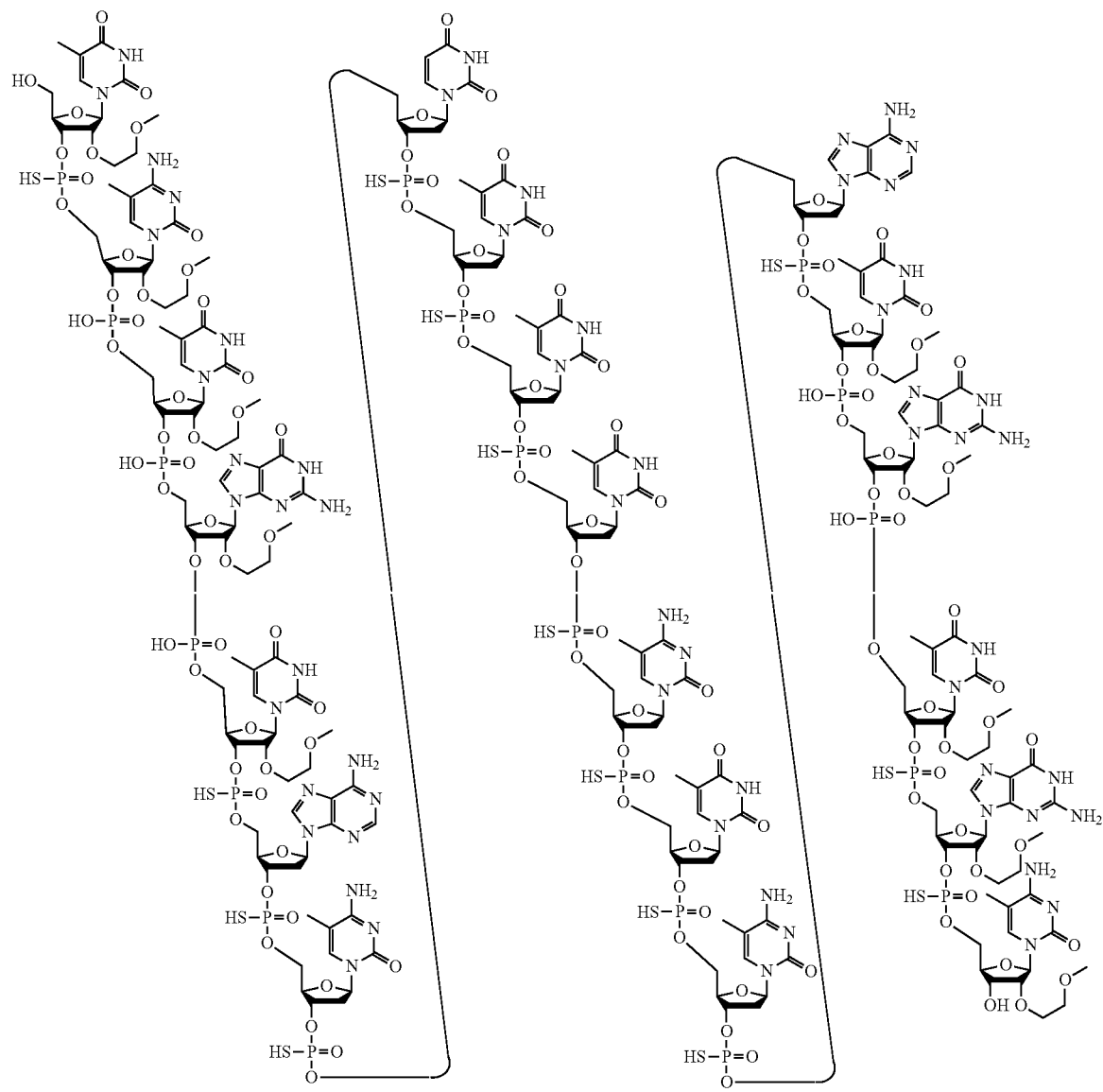
or a salt thereof.
Embodiment 43
The modified oligonucleotide of any of embodiments 37-42, which is a sodium salt of the formula.
Embodiment 44
A modified oligonucleotide according to the following formula:

SEQ ID NO: 1714
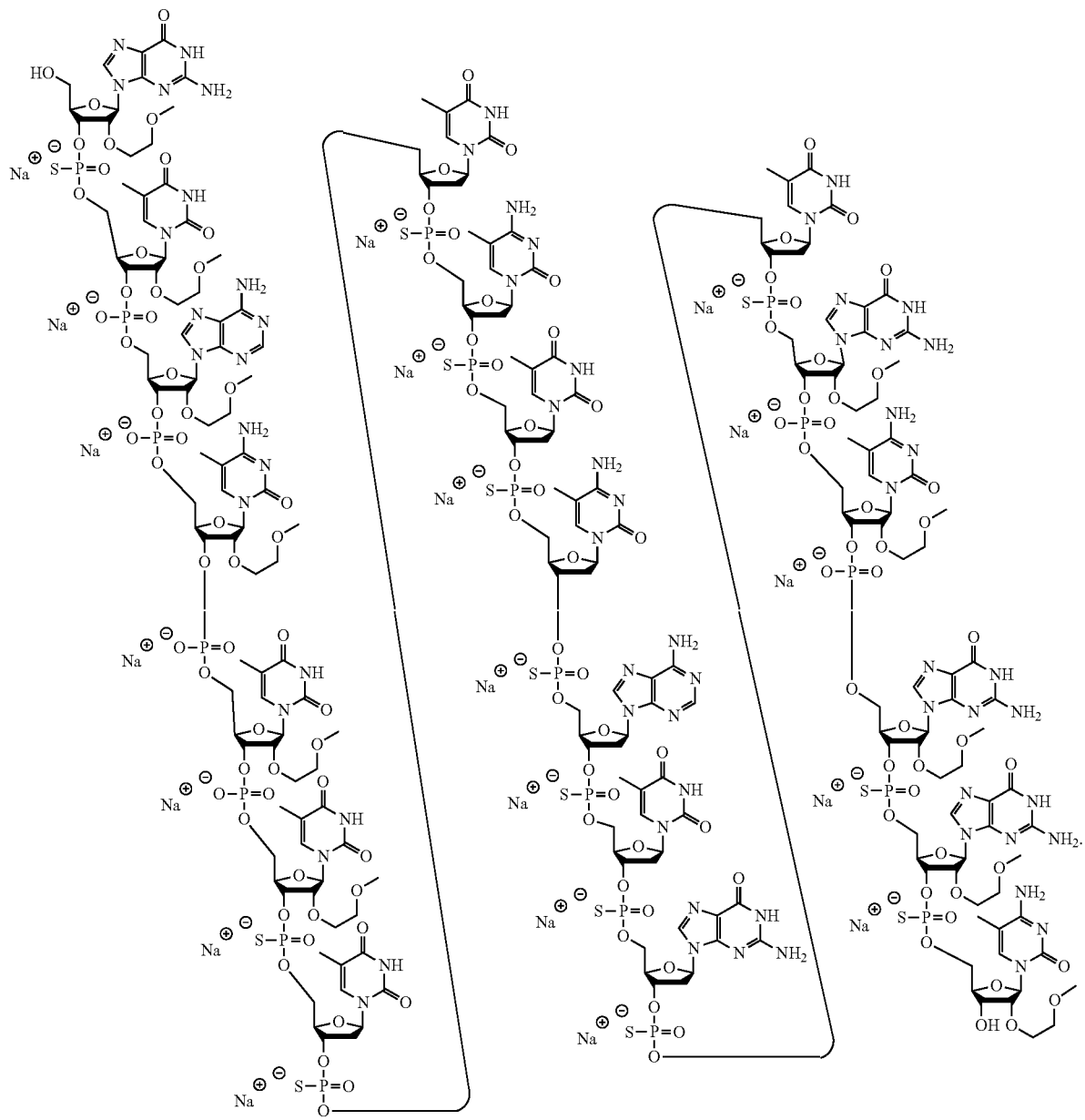
Embodiment 45
A modified oligonucleotide according to the following formula:

SEQ ID NO: 1255
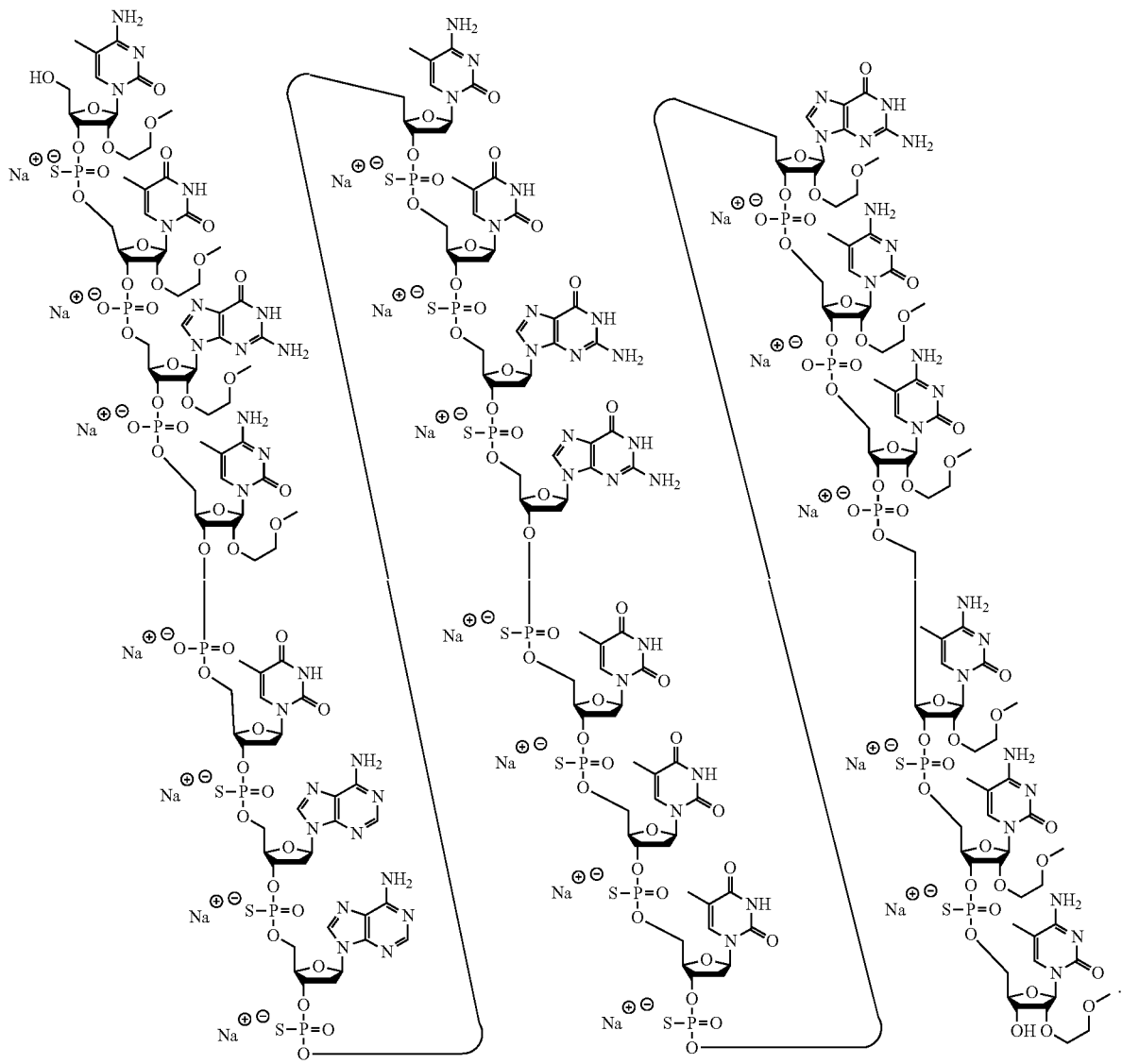
Embodiment 46
A modified oligonucleotide according to the following formula:

SEQ ID NO: 1185
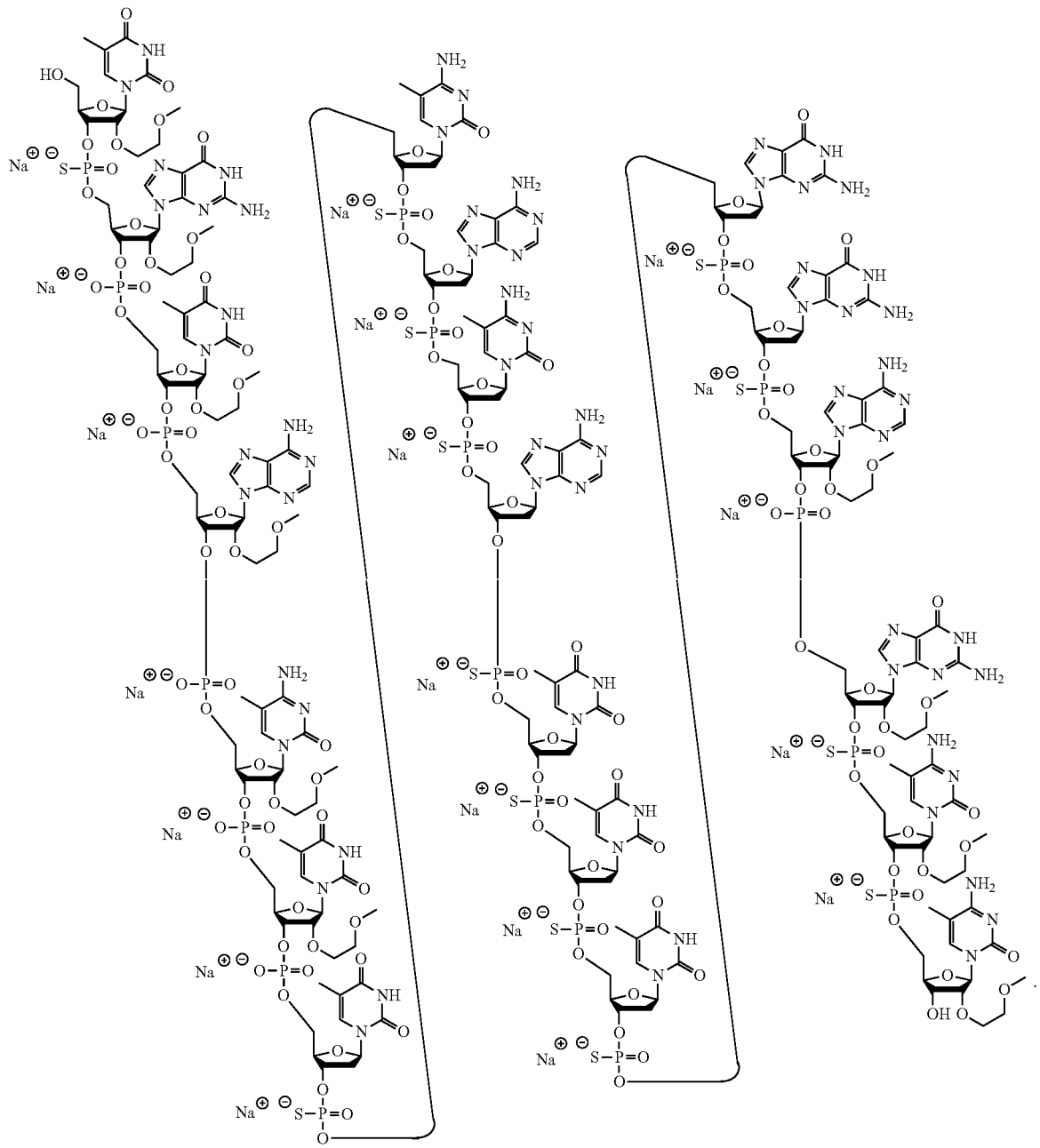
Embodiment 47
A modified oligonucleotide according to the following formula:

SEQ ID NO: 3235
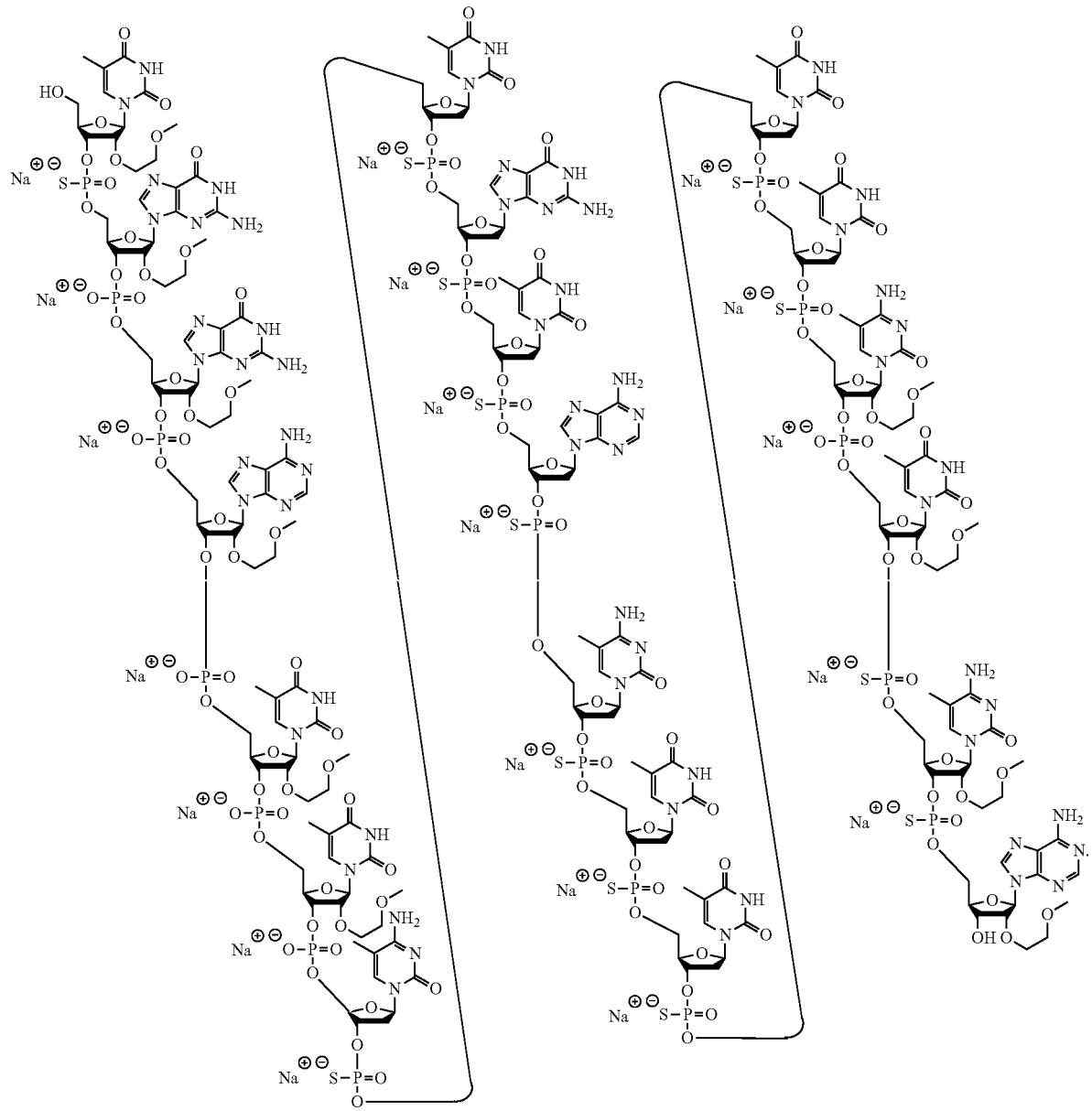
Embodiment 48
A modified oligonucleotide according to the following formula:

SEQ ID NO: 158
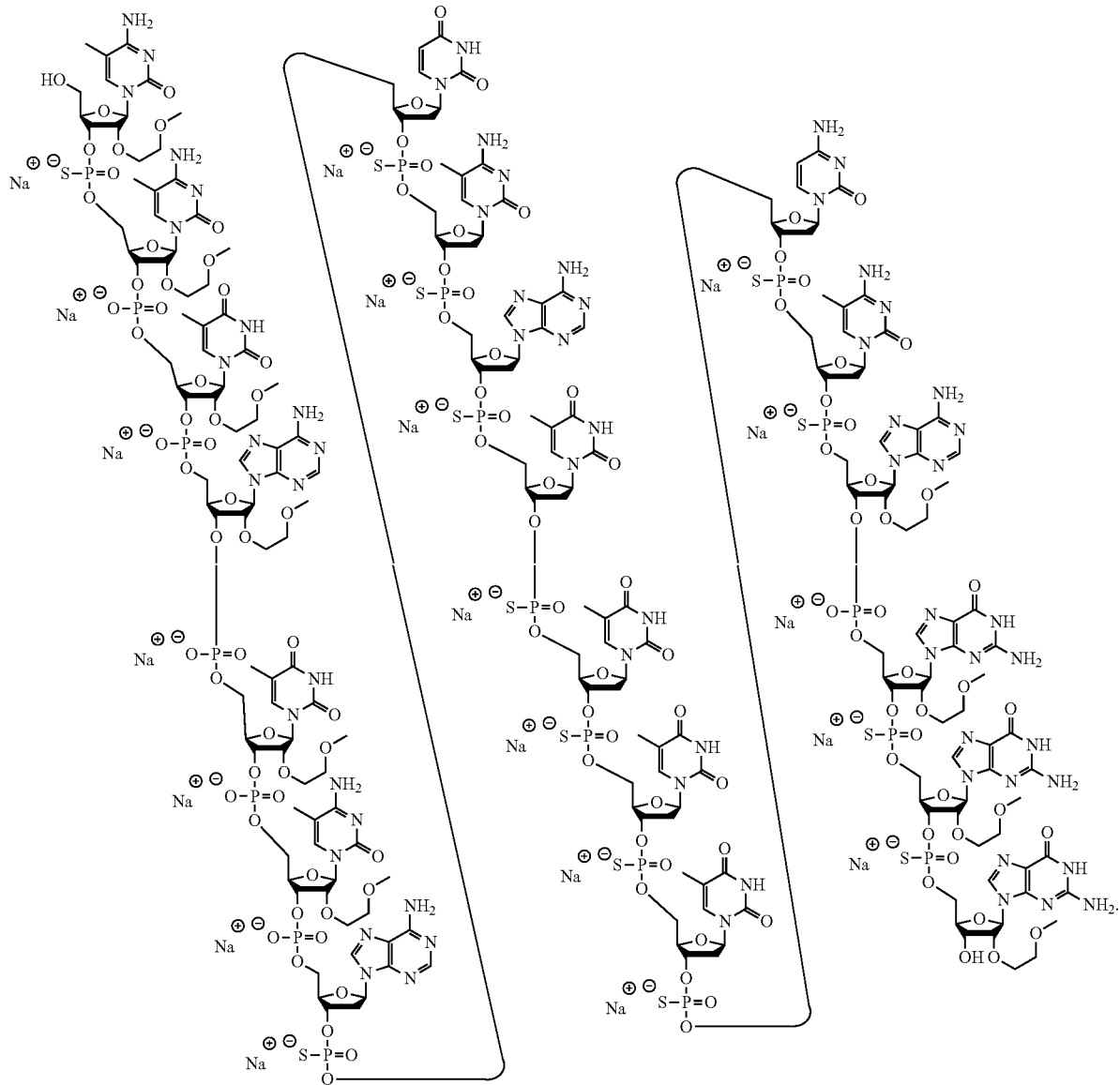
Embodiment 49
50
A modified oligonucleotide according to the following formula:

SEQ ID NO: 2544

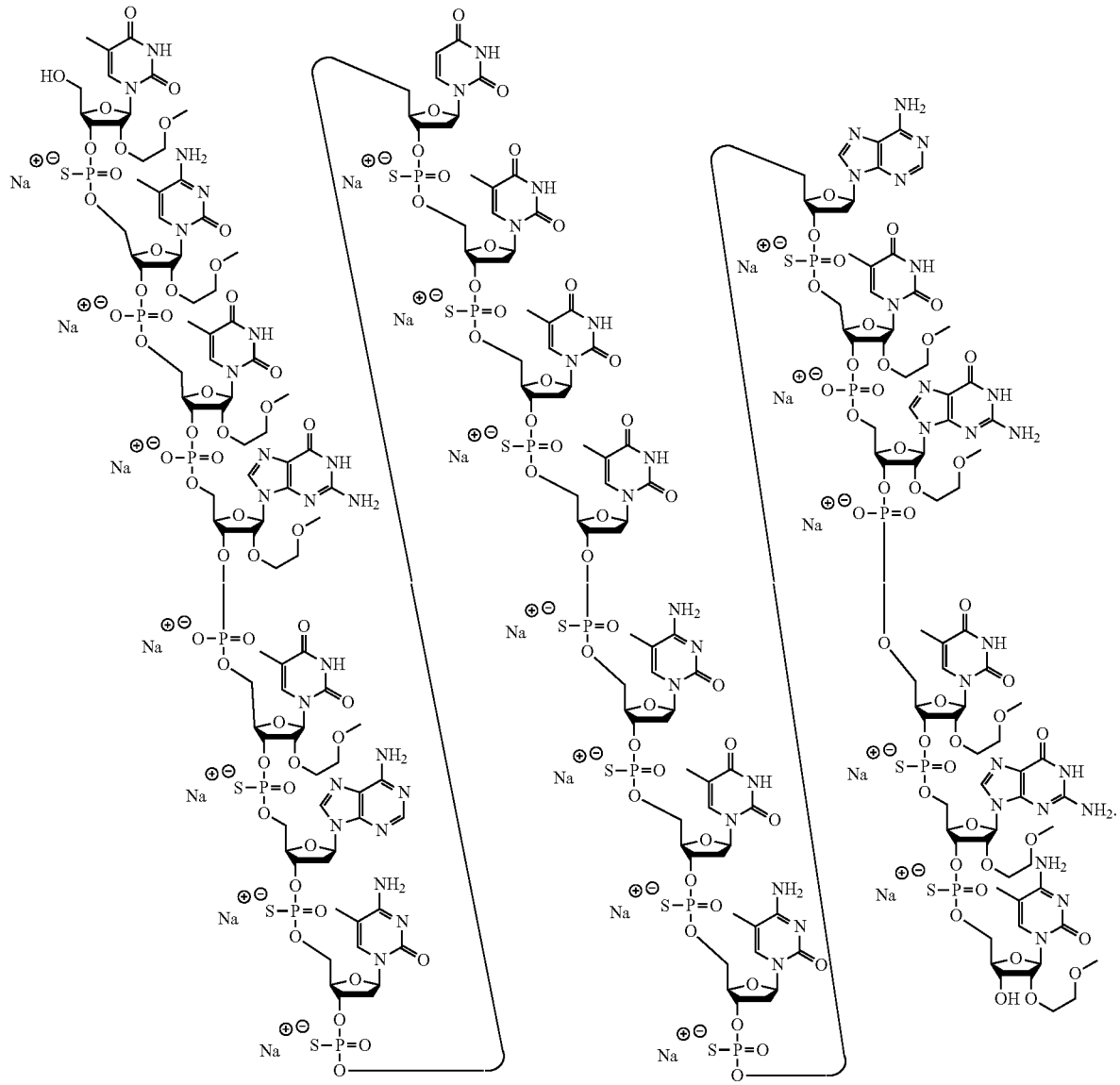

Embodiment 50

A chirally enriched population of the modified oligonucleotide of any of embodiments 37-49 wherein the population is enriched for modified oligonucleotides comprising at least one particular phosphorothioate internucleoside linkage having a particular stereochemical configuration.

Embodiment 51

The chirally enriched population of embodiment 50, wherein the population is enriched for modified oligonucleotides comprising at least one particular phosphorothioate internucleoside linkage having the (Sp) configuration.

Embodiment 52

The chirally enriched population of embodiment 50 or 51, wherein the population is enriched for modified oligonucleotides comprising at least one particular phosphorothioate internucleoside linkage having the (Rp) configuration.

Embodiment 53

The chirally enriched population of embodiment 50, wherein the population is enriched for modified oligonucleotides having a particular, independently selected stereochemical configuration at each phosphorothioate internucleoside linkage Embodiment 54

The chirally enriched population of embodiment 53, wherein the population is enriched for modified oligonucleotides having the (Sp) configuration at each phosphorothioate internucleoside linkage.

Embodiment 55

The chirally enriched population of embodiment 53, wherein the population is enriched for modified oligonucleotides having the (Rp) configuration at each phosphorothioate internucleoside linkage.

Embodiment 56

The chirally enriched population of embodiment 50 or embodiment 53 wherein the population is enriched for modified oligonucleotides having at least 3 contiguous phosphorothioate internucleoside linkages in the Sp-Sp-Rp configuration, in the 5' to 3' direction.

Embodiment 57

A population of modified oligonucleotides of any of embodiments 37-49, wherein all of the phosphorothioate internucleoside linkages of the modified oligonucleotide are stereorandom.

Embodiment 58

A pharmaceutical composition comprising the modified oligonucleotide of any of embodiments 37-49 and a pharmaceutically acceptable diluent or carrier.

Embodiment 59

The pharmaceutical composition of embodiment 58, wherein the pharmaceutically acceptable diluent is artificial cerebrospinal fluid.

Embodiment 60

The pharmaceutical composition of embodiment 59, wherein the pharmaceutical composition consists essentially of the modified oligonucleotide and artificial cerebrospinal fluid.

Embodiment 61

A method comprising administering to an animal a pharmaceutical composition of any of embodiments 36 or 58-60.

Embodiment 62

A method of treating a disease associated with ATXN2 comprising administering to an individual having or at risk for developing a disease associated with ATXN2 a therapeutically effective amount of a pharmaceutical composition according to any of embodiments 36 or 58-60; and thereby treating the disease associated with ATXN2.

Embodiment 63

The method of embodiment 62, wherein the disease associated with ATXN2 is a neurodegenerative disease.

Embodiment 64

The method of embodiment 63, wherein the neurodegenerative disease is any of spinocerebellar ataxia type 2 (SCA2), amyotrophic lateral sclerosis (ALS), and parkinsonism.

Embodiment 65

The method of embodiment 64, wherein at least one symptom or hallmark of the neurodegenerative disease is ameliorated.

Embodiment 66

The method of embodiment 65, wherein the symptom or hallmark is any of ataxia, neuropathy, and aggregate formation.

Embodiment 67

An oligomeric compound comprising a modified oligonucleotide according to the following formula:
Ges Teo Aeo mCeo Teo Tds Tds Tds mCds Tds mCds Ads Tds Gds Tds Geo mCeo Ges Ges mCe (SEQ ID NO: 1714); wherein,
  A=an adenine nucleobase,
  mC=a 5'-methyl cytosine nucleobase,
  G=a guanine nucleobase,
  T=a thymine nucleobase,
  e=a 2'-MOE modified sugar,
  d=a 2'-deoxyribose sugar,
  s=a phosphorothioate internucleoside linkage, and
  o=a phosphodiester internucleoside linkage.

Embodiment 68

An oligomeric compound comprising a modified oligonucleotide according to the following formula: mCes Teo Geo mCeo Tds Ads Ads mCds Tds Gds Gds Tds Tds Tds Geo mCeo mCeo mCes Tes Te (SEQ ID NO: 1255); wherein,
  A=an adenine nucleobase,
  mC=a 5'-methyl cytosine nucleobase,
  G=a guanine nucleobase,
  T=a thymine nucleobase,
  e=a 2'-MOE modified sugar,
  d=a 2'-deoxyribose sugar,
  s=a phosphorothioate internucleoside linkage, and
  o=a phosphodiester internucleoside linkage.

Embodiment 69

An oligomeric compound comprising a modified oligonucleotide according to the following formula: Tes Geo Teo Aeo mCeo Teo Tds mCds Ads mCds Ads Tds Tds Tds Gds Gds Aeo Ges mCes mCe (SEQ ID NO: 1185); wherein,
  A=an adenine nucleobase,
  mC=a 5'-methyl cytosine nucleobase,
  G=a guanine nucleobase,
  T=a thymine nucleobase,
  e=a 2'-MOE modified sugar,
  d=a 2'-deoxyribose sugar,
  s=a phosphorothioate internucleoside linkage, and
  o=a phosphodiester internucleoside linkage.

Embodiment 70

An oligomeric compound comprising a modified oligonucleotide according to the following formula: Tes Geo Geo Aeo Teo Teo mCds Tds Gds Tds Ads mCds Tds Tds Tds Tds mCeo Tes mCes Ae (SEQ ID NO: 3235); wherein,
  A=an adenine nucleobase,
  mC=a 5'-methyl cytosine nucleobase, G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.

Embodiment 71

An oligomeric compound comprising a modified oligonucleotide according to the following formula: mCes mCeo Teo Aeo Teo mCeo Ads Tds mCds Ads Tds Tds Tds Tds mCds mCds Aeo Ges Ges Ge (SEQ ID NO: 158); wherein,
A=an adenine nucleobase,
mC=a 5'-methyl cytosine nucleobase,
G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.

Embodiment 72

An oligomeric compound comprising a modified oligonucleotide according to the following formula: Tes mCeo Teo Geo Tes Ads mCds Tds Tds Tds Tds mCds Tds mCds Ads Teo Geo Tes Ges mCe (SEQ ID NO: 2544); wherein,
A=an adenine nucleobase,
mC=a 5'-methyl cytosine nucleobase,
G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.

Embodiment 73

The oligomeric compound of embodiment 3, wherein the modified oligonucleotide is an RNAi compound.

Embodiment 74

The oligomeric compound of embodiment 73, wherein the RNAi compound is an ssRNA or an siRNA.

I. Certain Oligonucleotides

In certain embodiments, provided herein are oligomeric compounds comprising oligonucleotides, which consist of linked nucleosides. Oligonucleotides may be unmodified oligonucleotides (RNA or DNA) or may be modified oligonucleotides. Modified oligonucleotides comprise at least one modification relative to unmodified RNA or DNA. That is, modified oligonucleotides comprise at least one modified nucleoside (comprising a modified sugar moiety and/or a modified nucleobase) and/or at least one modified internucleoside linkage.

A. Certain Modified Nucleosides

Modified nucleosides comprise a modified sugar moiety or a modified nucleobase or both a modifed sugar moiety and a modified nucleobase.

1. Certain Sugar Moieties

In certain embodiments, modified sugar moieties are non-bicyclic modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of other types of modified sugar moieties.

In certain embodiments, modified sugar moieties are non-bicyclic modified sugar moieties comprising a furanosyl ring with one or more substituent groups none of which bridges two atoms of the furanosyl ring to form a bicyclic structure. Such non bridging substituents may be at any position of the furanosyl, including but not limited to substituents at the 2', 4', and/or 5' positions. In certain embodiments one or more non-bridging substituent of non-bicyclic modified sugar moieties is branched. Examples of 2'-substituent groups suitable for non-bicyclic modified sugar moieties include but are not limited to: 2'-F, 2'-OCH$_3$ ("OMe" or "O-methyl"), and 2'-O(CH$_2$)$_2$OCH$_3$ ("MOE"). In certain embodiments, 2'-substituent groups are selected from among: halo, allyl, amino, azido, SH, CN, OCN, CF$_3$, OCF$_3$, O—C$_1$-C$_{10}$ alkoxy, O—C$_1$-C$_{10}$ substituted alkoxy, O—C$_1$-C$_{10}$ alkyl, O—C$_1$-C$_{10}$ substituted alkyl, S-alkyl, N(R$_m$)-alkyl, O-alkenyl, S-alkenyl, N(R$_m$)-alkenyl, O-alkynyl, S-alkynyl, N(R$_m$)-alkynyl, O-alkylenyl-O-alkyl, alkynyl, alkaryl, aralkyl, O-alkaryl, O-aralkyl, O(CH$_2$)$_2$SCH$_3$, O(CH$_2$)$_2$ON(R$_m$)(R$_n$) or OCH$_2$C(=O)—N(R$_m$)(R$_n$), where each R$_m$ and R$_n$ is, independently, H, an amino protecting group, or substituted or unsubstituted C$_1$-C$_{10}$ alkyl, and the 2'-substituent groups described in Cook et al., U.S. Pat. No. 6,531,584; Cook et al., U.S. Pat. No. 5,859,221; and Cook et al., U.S. Pat. No. 6,005,087. Certain embodiments of these 2'-substituent groups can be further substituted with one or more substituent groups independently selected from among: hydroxyl, amino, alkoxy, carboxy, benzyl, phenyl, nitro (NO$_2$), thiol, thioalkoxy, thioalkyl, halogen, alkyl, aryl, alkenyl and alkynyl. Examples of 4'-substituent groups suitable for non-bicyclic modified sugar moieties include but are not limited to alkoxy (e.g., methoxy), alkyl, and those described in Manoharan et al., WO 2015/106128. Examples of 5'-substituent groups suitable for non-bicyclic modified sugar moieties include but are not limited to: 5-methyl (R or S), 5'-vinyl, and 5'-methoxy. In certain embodiments, non-bicyclic modified sugar moieties comprise more than one non-bridging sugar substituent, for example, 2'-F-5'-methyl sugar moieties and the modified sugar moieties and modified nucleosides described in Migawa et al., WO 2008/101157 and Rajeev et al., US2013/0203836.

In certain embodiments, a 2'-substituted non-bicyclic modified nucleoside comprises a sugar moiety comprising a non-bridging 2'-substituent group selected from: F, NH$_2$, N$_3$, OCF$_3$, OCH$_3$, O(CH$_2$)$_3$NH$_2$, CH$_2$CH=CH$_2$, OCH$_2$CH=CH$_2$, OCH$_2$CH$_2$OCH$_3$, O(CH$_2$)$_2$SCH$_3$, O(CH$_2$)$_2$ON(R$_m$)(R$_n$), O(CH$_2$)$_2$O(CH$_2$)$_2$N(CH$_3$)$_2$, and N-substituted acetamide (OCH$_2$C(=O)—N(R$_m$)(R$_n$)), where each R$_m$ and R$_n$ is, independently, H, an amino protecting group, or substituted or unsubstituted C$_1$-C$_{10}$ alkyl.

In certain embodiments, a 2'-substituted nucleoside non-bicyclic modified nucleoside comprises a sugar moiety comprising a non-bridging 2'-substituent group selected from: F, OCF$_3$, OCH$_3$, OCH$_2$CH$_2$OCH$_3$, O(CH$_2$)$_2$SCH$_3$, O(CH$_2$)$_2$ON(CH$_3$)$_2$, O(CH$_2$)$_2$O(CH$_2$)$_2$N(CH$_3$)$_2$, and OCH$_2$C(=O)—N(H)CH$_3$ ("NMA").

In certain embodiments, a 2'-substituted non-bicyclic modified nucleoside comprises a sugar moiety comprising a non-bridging 2'-substituent group selected from: F, OCH$_3$, and OCH$_2$CH$_2$OCH$_3$.

Certain modified sugar moieties comprise a substituent that bridges two atoms of the furanosyl ring to form a second ring, resulting in a bicyclic sugar moiety. In certain such embodiments, the bicyclic sugar moiety comprises a bridge between the 4' and the 2' furanose ring atoms. Examples of such 4' to 2' bridging sugar substituents include but are not limited to: 4'-CH$_2$-2', 4'-(CH$_2$)$_2$-2', 4'-(CH$_2$)$_3$-2', 4'-CH$_2$—O-2' ("LNA"), 4'-CH$_2$—S-2', 4'-(CH$_2$)$_2$—O-2' ("ENA"), 4'-CH(CH$_3$)—O-2' (referred to as "constrained ethyl" or "cEt"), 4'-CH$_2$—O—CH$_2$-2', 4'-CH$_2$—N(R)-2', 4'-CH(CH$_2$OCH$_3$)—O-2' ("constrained MOE" or "cMOE") and analogs thereof (see, e.g., Seth et al., U.S. Pat. No. 7,399,845, Bhat et al., U.S. Pat. No. 7,569,686, Swayze et al., U.S. Pat. No. 7,741,457, and Swayze et al., U.S. Pat. No. 8,022,193), 4'-C(CH$_3$)(CH$_3$)—O-2' and analogs thereof (see, e.g., Seth et al., U.S. Pat. No. 8,278,283), 4'-CH$_2$—N(OCH$_3$)-2' and analogs thereof (see, e.g., Prakash et al., U.S. Pat. No. 8,278,425), 4'-CH$_2$—O—N(CH$_3$)-2' (see, e.g., Allerson et al., U.S. Pat. No. 7,696,345 and Allerson et al., U.S. Pat. No. 8,124,745), 4'-CH$_2$—C(H)(CH$_3$)-2' (see, e.g., Zhou, et al., J. Org. Chem., 2009, 74, 118-134), 4'-CH$_2$—C(=CH$_2$)-2' and analogs thereof (see e.g., Seth et al., U.S. Pat. No. 8,278,426), 4'-C(R$_a$R$_b$)—N(R)—O-2', 4'-C(R$_a$R$_b$)—O—N(R)-2', 4'-CH$_2$—O—N(R)-2', and 4'-CH$_2$—N(R)—O- 2', wherein each R, R$_a$, and R$_b$ is, independently, H, a protecting group, or C$_1$-C$_{12}$ alkyl (see, e.g. Imanishi et al., U.S. Pat. No. 7,427,672).

In certain embodiments, such 4' to 2' bridges independently comprise from 1 to 4 linked groups independently selected from: —[C(R$_a$)(R$_b$)]$_n$—, —[C(R$_a$)(R$_b$)]$_n$—O—, —C(R$_a$)=C(R$_b$)—, —C(R$_a$)=N—, —C(=NR$_a$)—, —C(=O)—, —C(=S)—, —O—, —Si(R$_a$)$_2$—, —S(=O)$_x$—, and —N(R$_a$)—;

wherein:

x is 0, 1, or 2;

n is 1, 2, 3, or 4;

each R$_a$ and R$_b$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)$_2$-J$_1$), or sulfoxyl (S(=O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, C$_1$-C$_{12}$ aminoalkyl, substituted C$_1$-C$_{12}$ aminoalkyl, or a protecting group.

Additional bicyclic sugar moieties are known in the art, see, for example: Freier et al., *Nucleic Acids Research*, 1997, 25(22), 4429-4443, Albaek et al., *J. Org. Chem.*, 2006, 71, 7731-7740, Singh et al., *Chem. Commun.*, 1998, 4, 455-456; Koshkin et al., *Tetrahedron*, 1998, 54, 3607-3630; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 2007, 129, 8362-8379; Wengel et a., U.S. Pat. No. 7,053,207; Imanishi et al., U.S. Pat. No. 6,268,490; Imanishi et al. U.S. Pat. No. 6,770,748; Imanishi et al., U.S. Pat. No. RE44,779; Wengel et al., U.S. Pat. No. 6,794,499; Wengel et al., U.S. Pat. No. 6,670,461; Wengel et al., U.S. Pat. No. 7,034,133; Wengel et al., U.S. Pat. No. 8,080,644; Wengel et al., U.S. Pat. No. 8,034,909; Wengel et al., U.S. Pat. No. 8,153,365; Wengel et al., U.S. Pat. No. 7,572,582; and Ramasamy et al., U.S. Pat. No. 6,525,191; Torsten et al., WO 2004/106356; Wengel et al., WO 1999/014226; Seth et al., WO 2007/134181; Seth et al., U.S. Pat. No. 7,547,684; Seth et al., U.S. Pat. No. 7,666,854; Seth et al., U.S. Pat. No. 8,088,746; Seth et al., U.S. Pat. No. 7,750,131; Seth et al., U.S. Pat. No. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421; Seth et al., U.S. Pat. No. 8,501,805; and U.S. Patent Publication Nos. Allerson et al., US2008/0039618 and Migawa et al., US2015/0191727.

In certain embodiments, bicyclic sugar moieties and nucleosides incorporating such bicyclic sugar moieties are further defined by isomeric configuration. For example, an LNA nucleoside (described herein) may be in the α-L configuration or in the β-D configuration.

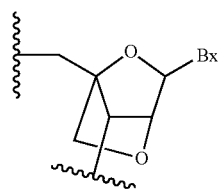

LNA (β-D-configuration)
bridge = 4'-CH$_2$—O-2'

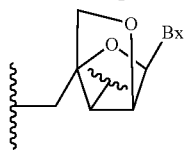

α-L-LNA (α-L-configuration)
bridge = 4'-CH$_2$—O-2'

α-L-methyleneoxy (4'-CH$_2$—O-2') or α-L-LNA bicyclic nucleosides have been incorporated into oligonucleotides that showed antisense activity (Frieden et al., *Nucleic Acids Research*, 2003, 21, 6365-6372). Herein, general descriptions of bicyclic nucleosides include both isomeric configurations. When the positions of specific bicyclic nucleosides (e.g., LNA or cEt) are identified in exemplified embodiments herein, they are in the β-D configuration, unless otherwise specified.

In certain embodiments, modified sugar moieties comprise one or more non-bridging sugar substituent and one or more bridging sugar substituent (e.g., 5'-substituted and 4'-2' bridged sugars).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described herein. For example, certain sugar surrogates comprise a 4'-sulfur atom and a substitution at the 2'-position (see, e.g., Bhat et al., U.S. Pat. No. 7,875,733 and Bhat et al., U.S. Pat. No. 7,939,677) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("MNA") (see, e.g., Leumann, C J. *Bioorg. & Med. Chem.* 2002, 10, 841-854), fluoro HNA:

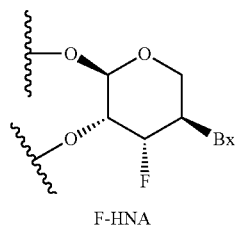

F-HNA ("F-HNA", see e.g. Swayze et al., U.S. Pat. No. 8,088,904; Swayze et al., U.S. Pat. No. 8,440,803; Swayze et al., U.S. Pat. No. 8,796,437; and Swayze et al., U.S. Pat. No. 9,005,906; F-HNA can also be referred to as a F-THP or 3'-fluoro tetrahydropyran), and nucleosides comprising additional modified THP compounds having the formula:

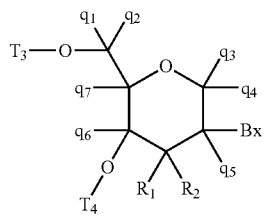

wherein, independently, for each of said modified THP nucleoside:

Bx is a nucleobase moiety;

$T_3$ and $T_4$ are each, independently, an internucleoside linking group linking the modified THP nucleoside to the remainder of an oligonucleotide or one of $T_3$ and $T_4$ is an internucleoside linking group linking the modified THP nucleoside to the remainder of an oligonucleotide and the other of $T_3$ and $T_4$ is H, a hydroxyl protecting group, a linked conjugate group, or a 5' or 3'-terminal group;

$q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$, and CN, wherein X is O, S or $NJ_1$, and each $J_1$, $J_2$, and $J_3$ is, independently, H or $C_1$-$C_6$ alkyl.

In certain embodiments, modified THP nucleosides are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, modified THP nucleosides are provided wherein one of $R_1$ and $R_2$ is F. In certain embodiments, $R_1$ is F and $R_2$ is H, in certain embodiments, $R_1$ is methoxy and $R_2$ is H, and in certain embodiments, $R_1$ is methoxyethoxy and $R_2$ is H.

In certain embodiments, sugar surrogates comprise rings having more than 5 atoms and more than one heteroatom. For example, nucleosides comprising morpholino sugar moieties and their use in oligonucleotides have been reported (see, e.g., Braasch et al., Biochemistry, 2002, 41, 4503-4510 and Summerton et al., U.S. Pat. No. 5,698,685; Summerton et al., U.S. Pat. No. 5,166,315; Summerton et al., U.S. Pat. No. 5,185,444; and Summerton et al., U.S. Pat. No. 5,034,506). As used here, the term "morpholino" means a sugar surrogate having the following structure:

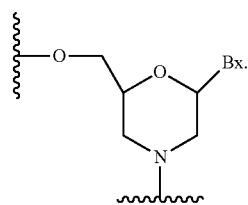

In certain embodiments, morpholinos may be modified, for example by adding or altering various substituent groups from the above morpholino structure. Such sugar surrogates are referred to herein as "modifed morpholinos."

In certain embodiments, sugar surrogates comprise acyclic moieites. Examples of nucleosides and oligonucleotides comprising such acyclic sugar surrogates include but are not limited to: peptide nucleic acid ("PNA"), acyclic butyl nucleic acid (see, e.g., Kumar et al., Org. Biomol. Chem., 2013, 11, 5853-5865), and nucleosides and oligonucleotides described in Manoharan et al., WO2011/133876.

Many other bicyclic and tricyclic sugar and sugar surrogate ring systems are known in the art that can be used in modified nucleosides.

2. Certain Modified Nucleobases

In certain embodiments, modified oligonucleotides comprise one or more nucleoside comprising an unmodified nucleobase. In certain embodiments, modified oligonucleotides comprise one or more nucleoside comprising a modified nucleobase. In certain embodiments, modified oligonucleotides comprise one or more nucleoside that does not comprise a nucleobase, referred to as an abasic nucleoside.

In certain embodiments, modified nucleobases are selected from: 5-substituted pyrimidines, 6-azapyrimidines, alkyl or alkynyl substituted pyrimidines, alkyl substituted purines, and N-2, N-6 and O-6 substituted purines. In certain embodiments, modified nucleobases are selected from: 2-aminopropyladenine, 5-hydroxymethyl cytosine, xanthine, hypoxanthine, 2-aminoadenine, 6-N-methylguanine, 6-N-methyladenine, 2-propyladenine 2-thiouracil, 2-thiothymine and 2-thiocytosine, 5-propynyl (—C≡C—CH$_3$) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp). Modified nucleobases may also include those in which the purine or pyrimidine base is replaced with other heterocycles, for example 7-deazaadenine, 7-deazaguanosine, 2-aminopyridine and 2-pyridone. Further nucleobases include those disclosed in Merigan et al., U.S. Pat. No. 3,687,808, those disclosed in i The Concise Encyclopedia Of Polymer Science And Engineering, Kroschwitz, J. I., Ed., John Wiley & Sons, 1990, 858-859; Englisch et al., Angewandte Chemie, International Edition, 1991, 30, 613; Sanghvi, Y. S., Chapter 15, Antisense Research and Applications, Crooke, S. T. and Lebleu, B., Eds., CRC Press, 1993, 273-288; and those disclosed in Chapters 6 and 15, *Antisense Drug Technology*, Crooke S. T., Ed., CRC Press, 2008, 163-166 and 442-443.

Publications that teach the preparation of certain of the above noted modified nucleobases as well as other modified nucleobases include without limitation, Manohara et al., US2003/0158403; Manoharan et al., US2003/0175906; Dinh et al., U.S. Pat. No. 4,845,205; Spielvogel et al., U.S. Pat. No. 5,130,302; Rogers et al., U.S. Pat. No. 5,134,066; Bischofberger et al., U.S. Pat. No. 5,175,273; Urdea et al., U.S. Pat. No. 5,367,066; Benner et al., U.S. Pat. No. 5,432,272; Matteucci et al., U.S. Pat. No. 5,434,257; Gmeiner et al., U.S. Pat. No. 5,457,187; Cook et al., U.S. Pat. No. 5,459,255; Froehler et al., U.S. Pat. No. 5,484,908; Matteucci et al., U.S. Pat. No. 5,502,177; Hawkins et al., U.S. Pat. No. 5,525,711; Haralambidis et al., U.S. Pat. No. 5,552,540; Cook et al., U.S. Pat. No. 5,587,469; Froehler et al., U.S. Pat. No. 5,594,121; Switzer et al., U.S. Pat. No. 5,596,091; Cook et al., U.S. Pat. No. 5,614,617; Froehler et al., U.S. Pat. No. 5,645,985; Cook et al., U.S. Pat. No. 5,681,941; Cook et al., U.S. Pat. No. 5,811,534; Cook et al., U.S. Pat. No. 5,750,692; Cook et al., U.S. Pat. No. 5,948,903; Cook et al., U.S. Pat. No. 5,587,470; Cook et al., U.S. Pat. No. 5,457,191; Matteucci et al., U.S. Pat. No. 5,763,588; Froehler et al., U.S. Pat. No. 5,830,653; Cook et al., U.S. Pat. No. 5,808,027; Cook et al., U.S. Pat. No. 6,166,199; and Matteucci et al., U.S. Pat. No. 6,005,096.

3. Certain Modified Internucleoside Linkages

In certain embodiments, nucleosides of modified oligonucleotides may be linked together using any internucleoside linkage. The two main classes of internucleoside linking groups are defined by the presence or absence of a phosphorus atom. Representative phosphorus-containing internucleoside linkages include but are not limited to phosphates, which contain a phosphodiester bond ("P=O") (also referred to as unmodified or naturally occurring linkages), phosphotriesters, methylphosphonates, phosphoramidates, and phosphorothioates ("P=S"), and phosphorodithioates ("HS—P=S"). Representative non-phosphorus containing internucleoside linking groups include but are not limited to methylenemethylimino (—CH$_2$—N(CH$_3$)—O—CH$_2$—), thiodiester, thionocarbamate (—O—C(=O)(NH)—S—); siloxane (—O—SiH$_2$—O—); and N,N'-dimethylhydrazine (—CH$_2$—N(CH$_3$)—N(CH$_3$)—). Modified internucleoside linkages, compared to naturally occurring phosphate linkages, can be used to alter, typically increase, nuclease resistance of the oligonucleotide. In certain embodiments, internucleoside linkages having a chiral atom can be prepared as a racemic mixture, or as separate enantiomers. Methods of preparation of phosphorous-containing and non-phosphorous-containing internucleoside linkages are well known to those skilled in the art.

Representative internucleoside linkages having a chiral center include but are not limited to alkylphosphonates and phosphorothioates. Modified oligonucleotides comprising internucleoside linkages having a chiral center can be prepared as populations of modified oligonucleotides comprising stereorandom internucleoside linkages, or as populations of modified oligonucleotides comprising phosphorothioate linkages in particular stereochemical configurations. In certain embodiments, populations of modified oligonucleotides comprise phosphorothioate internucleoside linkages wherein all of the phosphorothioate internucleoside linkages are stereorandom. Such modified oligonucleotides can be generated using synthetic methods that result in random selection of the stereochemical configuration of each phosphorothioate linkage. Nonetheless, as is well understood by those of skill in the art, each individual phosphorothioate of each individual oligonucleotide molecule has a defined stereoconfiguration. In certain embodiments, populations of modified oligonucleotides are enriched for modified oligonucleotides comprising one or more particular phosphorothioate internucleoside linkages in a particular, independently selected stereochemical configuration. In certain embodiments, the particular configuration of the particular phosphorothioate linkage is present in at least 65% of the molecules in the population. In certain embodiments, the particular configuration of the particular phosphorothioate linkage is present in at least 70% of the molecules in the population. In certain embodiments, the particular configuration of the particular phosphorothioate linkage is present in at least 80% of the molecules in the population. In certain embodiments, the particular configuration of the particular phosphorothioate linkage is present in at least 90% of the molecules in the population. In certain embodiments, the particular configuration of the particular phosphorothioate linkage is present in at least 99% of the molecules in the population. Such chirally enriched populations of modified oligonucleotides can be generated using synthetic methods known in the art, e.g., methods described in Oka et al., *JACS* 125, 8307 (2003), Wan et al. *Nuc. Acid. Res.* 42, 13456 (2014), and WO 2017/015555. In certain embodiments, a population of modified oligonucleotides is enriched for modified oligonucleotides having at least one indicated phosphorothioate in the (Sp) configuration. In certain embodiments, a population of modified oligonucleotides is enriched for modified oligonucleotides having at least one phosphorothioate in the (Rp) configuration. In certain embodiments, modified oligonucleotides comprising (Rp) and/or (Sp) phosphorothioates comprise one or more of the following formulas, respectively, wherein "B" indicates a nucleobase:

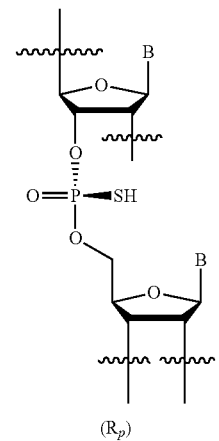

(R$_p$)

-continued

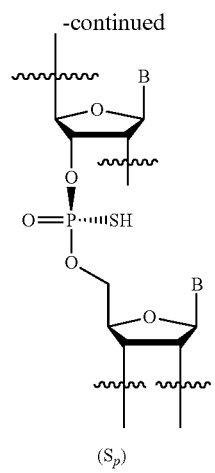

($S_p$)

Unless otherwise indicated, chiral internucleoside linkages of modified oligonucleotides described herein can be stereorandom or in a particular stereochemical configuration.

Neutral internucleoside linkages include, without limitation, phosphotriesters, methylphosphonates, MMI (3'-$CH_2$—N($CH_3$)—O-5'), amide-3 (3'-$CH_2$—C(=O)—N(H)-5'), amide-4 (3'-$CH_2$—N(H)—C(=O)-5'), formacetal (3'-O—$CH_2$—O-5'), methoxypropyl, and thioformacetal (3'-S—$CH_2$—O-5'). Further neutral internucleoside linkages include nonionic linkages comprising siloxane (dialkylsiloxane), carboxylate ester, carboxamide, sulfide, sulfonate ester and amides (See for example: *Carbohydrate Modifications in Antisense Research*; Y. S. Sanghvi and P. D. Cook, Eds., ACS Symposium Series 580; Chapters 3 and 4, 40-65). Further neutral internucleoside linkages include nonionic linkages comprising mixed N, O, S and $CH_2$ component parts.

B. Certain Motifs

In certain embodiments, modified oligonucleotides comprise one or more modified nucleosides comprising a modified sugar moiety. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patterns of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

1. Certain Sugar Motifs

In certain embodiments, oligonucleotides comprise one or more type of modified sugar and/or unmodified sugar moiety arranged along the oligonucleotide or region thereof in a defined pattern or sugar motif. In certain instances, such sugar motifs include but are not limited to any of the sugar modifications discussed herein.

In certain embodiments, modified oligonucleotides comprise or consist of a region having a gapmer motif, which is defined by two external regions or "wings" and a central or internal region or "gap." The three regions of a gapmer motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap (i.e., the wing/gap junction). In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar motifs of the two wings are the same as one another (symmetric gapmer). In certain embodiments, the sugar motif of the 5'-wing differs from the sugar motif of the 3'-wing (asymmetric gapmer).

In certain embodiments, the wings of a gapmer comprise 1-5 nucleosides. In certain embodiments, each nucleoside of each wing of a gapmer is a modified nucleoside. In certain embodiments, at least one nucleoside of each wing of a gapmer is a modified nucleoside. In certain embodiments, at least two nucleosides of each wing of a gapmer are modified nucleosides. In certain embodiments, at least three nucleosides of each wing of a gapmer are modified nucleosides. In certain embodiments, at least four nucleosides of each wing of a gapmer are modified nucleosides.

In certain embodiments, the gap of a gapmer comprises 7-12 nucleosides. In certain embodiments, each nucleoside of the gap of a gapmer is an unmodified 2'-deoxy nucleoside. In certain embodiments, at least one nucleoside of the gap of a gapmer is a modified nucleoside.

In certain embodiments, the gapmer is a deoxy gapmer. In certain embodiments, the nucleosides on the gap side of each wing/gap junction are unmodified 2'-deoxy nucleosides and the nucleosides on the wing sides of each wing/gap junction are modified nucleosides. In certain embodiments, each nucleoside of the gap is an unmodified 2'-deoxy nucleoside. In certain embodiments, each nucleoside of each wing of a gapmer is a modified nucleoside.

In certain embodiments, modified oligonucleotides comprise or consist of a region having a fully modified sugar motif. In such embodiments, each nucleoside of the fully modified region of the modified oligonucleotide comprises a modified sugar moiety. In certain embodiments, each nucleoside of the entire modified oligonucleotide comprises a modified sugar moiety. In certain embodiments, modified oligonucleotides comprise or consist of a region having a fully modified sugar motif, wherein each nucleoside within the fully modified region comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified comprises the same 2'-modification.

Herein, the lengths (number of nucleosides) of the three regions of a gapmer may be provided using the notation [# of nucleosides in the 5'-wing]-[# of nucleosides in the gap]-[# of nucleosides in the 3'-wing]. Thus, a 5-10-5 gapmer consists of 5 linked nucleosides in each wing and 10 linked nucleosides in the gap. Where such nomenclature is followed by a specific modification, that modification is the modification in each sugar moiety of each wing and the gap nucleosides comprise unmodified deoxynucleosides sugars. Thus, a 5-10-5 MOE gapmer consists of 5 linked MOE modified nucleosides in the 5'-wing, 10 linked deoxynucleosides in the gap, and 5 linked MOE nucleosides in the 3'-wing.

In certain embodiments, modified oligonucleotides are 5-10-5 MOE gapmers. In certain embodiments, modified oligonucleotides are 3-10-3 BNA gapmers. In certain embodiments, modified oligonucleotides are 3-10-3 cEt gapmers. In certain embodiments, modified oligonucleotides are 3-10-3 LNA gapmers.

2. Certain Nucleobase Motifs

In certain embodiments, oligonucleotides comprise modified and/or unmodified nucleobases arranged along the oligonucleotide or region thereof in a defined pattern or motif. In certain embodiments, each nucleobase is modified. In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methyl cytosines. In certain embodiments, all of the cytosine nucleobases are 5-methyl cytosines and all of the other nucleobases of the modified oligonucleotide are unmodified nucleobases.

In certain embodiments, modified oligonucleotides comprise a block of modified nucleobases. In certain such embodiments, the block is at the 3'-end of the oligonucleotide. In certain embodiments the block is within 3 nucleosides of the 3'-end of the oligonucleotide. In certain embodiments, the block is at the 5'-end of the oligonucleotide. In certain embodiments the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the central gap of an oligonucleotide having a gapmer motif. In certain such embodiments, the sugar moiety of said nucleoside is a 2'-deoxyribosyl moiety. In certain embodiments, the modified nucleobase is selected from: a 2-thiopyrimidine and a 5-propynepyrimidine.

3. Certain Internucleoside Linkage Motifs

In certain embodiments, oligonucleotides comprise modified and/or unmodified internucleoside linkages arranged along the oligonucleotide or region thereof in a defined pattern or motif. In certain embodiments, each internucleoside linking group is a phosphodiester internucleoside linkage (P=O). In certain embodiments, each internucleoside linking group of a modified oligonucleotide is a phosphorothioate internucleoside linkage (P=S). In certain embodiments, each internucleoside linkage of a modified oligonucleotide is independently selected from a phosphorothioate internucleoside linkage and phosphodiester internucleoside linkage. In certain embodiments, each phosphorothioate internucleoside linkage is independently selected from a stereorandom phosphorothioate, a (Sp) phosphorothioate, and a (Rp) phosphorothioate. In certain embodiments, the sugar motif of a modified oligonucleotide is a gapmer and the internucleoside linkages within the gap are all modified. In certain such embodiments, some or all of the internucleoside linkages in the wings are unmodified phosphodiester internucleoside linkages. In certain embodiments, the terminal internucleoside linkages are modified. In certain embodiments, the sugar motif of a modified oligonucleotide is a gapmer, and the internucleoside linkage motif comprises at least one phosphodiester internucleoside linkage in at least one wing, wherein the at least one phosphodiester linkage is not a terminal internucleoside linkage, and the remaining internucleoside linkages are phosphorothioate internucleoside linkages. In certain such embodiments, all of the phosphorothioate linkages are stereorandom. In certain embodiments, all of the phosphorothioate linkages in the wings are (Sp) phosphorothioates, and the gap comprises at least one Sp, Sp, Rp motif. In certain embodiments, populations of modified oligonucleotides are enriched for modified oligonucleotides comprising such internucleoside linkage motifs.

C. Certain Lengths

It is possible to increase or decrease the length of an oligonucleotide without eliminating activity. For example, in Woolf et al. (Proc. Natl. Acad. Sci. USA 89:7305-7309, 1992), a series of oligonucleotides 13-25 nucleobases in length were tested for their ability to induce cleavage of a target RNA in an oocyte injection model. Oligonucleotides 25 nucleobases in length with 8 or 11 mismatch bases near the ends of the oligonucleotides were able to direct specific cleavage of the target mRNA, albeit to a lesser extent than the oligonucleotides that contained no mismatches. Similarly, target specific cleavage was achieved using 13 nucleobase oligonucleotides, including those with 1 or 3 mismatches.

In certain embodiments, oligonucleotides (including modified oligonucleotides) can have any of a variety of ranges of lengths. In certain embodiments, oligonucleotides consist of X to Y linked nucleosides, where X represents the fewest number of nucleosides in the range and Y represents the largest number nucleosides in the range. In certain such embodiments, X and Y are each independently selected from 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50; provided that X≤Y. For example, in certain embodiments, oligonucleotides consist of 12 to 13, 12 to 14, 12 to 15, 12 to 16, 12 to 17, 12 to 18, 12 to 19, 12 to 20, 12 to 21, 12 to 22, 12 to 23, 12 to 24, 12 to 25, 12 to 26, 12 to 27, 12 to 28, 12 to 29, 12 to 30, 13 to 14, 13 to 15, 13 to 16, 13 to 17, 13 to 18, 13 to 19, 13 to 20, 13 to 21, 13 to 22, 13 to 23, 13 to 24, 13 to 25, 13 to 26, 13 to 27, 13 to 28, 13 to 29, 13 to 30, 14 to 15, 14 to 16, 14 to 17, 14 to 18, 14 to 19, 14 to 20, 14 to 21, 14 to 22, 14 to 23, 14 to 24, 14 to 25, 14 to 26, 14 to 27, 14 to 28, 14 to 29, 14 to 30, 15 to 16, 15 to 17, 15 to 18, 15 to 19, 15 to 20, 15 to 21, 15 to 22, 15 to 23, 15 to 24, 15 to 25, 15 to 26, 15 to 27, 15 to 28, 15 to 29, 15 to 30, 16 to 17, 16 to 18, 16 to 19, 16 to 20, 16 to 21, 16 to 22, 16 to 23, 16 to 24, 16 to 25, 16 to 26, 16 to 27, 16 to 28, 16 to 29, 16 to 30, 17 to 18, 17 to 19, 17 to 20, 17 to 21, 17 to 22, 17 to 23, 17 to 24, 17 to 25, 17 to 26, 17 to 27, 17 to 28, 17 to 29, 17 to 30, 18 to 19, 18 to 20, 18 to 21, 18 to 22, 18 to 23, 18 to 24, 18 to 25, 18 to 26, 18 to 27, 18 to 28, 18 to 29, 18 to 30, 19 to 20, 19 to 21, 19 to 22, 19 to 23, 19 to 24, 19 to 25, 19 to 26, 19 to 29, 19 to 28, 19 to 29, 19 to 30, 20 to 21, 20 to 22, 20 to 23, 20 to 24, 20 to 25, 20 to 26, 20 to 27, 20 to 28, 20 to 29, 20 to 30, 21 to 22, 21 to 23, 21 to 24, 21 to 25, 21 to 26, 21 to 27, 21 to 28, 21 to 29, 21 to 30, 22 to 23, 22 to 24, 22 to 25, 22 to 26, 22 to 27, 22 to 28, 22 to 29, 22 to 30, 23 to 24, 23 to 25, 23 to 26, 23 to 27, 23 to 28, 23 to 29, 23 to 30, 24 to 25, 24 to 26, 24 to 27, 24 to 28, 24 to 29, 24 to 30, 25 to 26, 25 to 27, 25 to 28, 25 to 29, 25 to 30, 26 to 27, 26 to 28, 26 to 29, 26 to 30, 27 to 28, 27 to 29, 27 to 30, 28 to 29, 28 to 30, or 29 to 30 linked nucleosides D. Certain Modified Oligonucleotides In certain embodiments, the above modifications (sugar, nucleobase, internucleoside linkage) are incorporated into a modified oligonucleotide. In certain embodiments, modified oligonucleotides are characterized by their modification motifs and overall lengths. In certain embodiments, such parameters are each independent of one another. Thus, unless otherwise indicated, each internucleoside linkage of an oligonucleotide having a gapmer sugar motif may be modified or unmodified and may or may not follow the gapmer modification pattern of the sugar modifications. For example, the internucleoside linkages within the wing regions of a sugar gapmer may be the same or different from one another and may be the same or different from the internucleoside linkages of the gap region of the sugar motif. Likewise, such sugar gapmer oligonucleotides may comprise one or more modified nucleobase independent of the gapmer pattern of the sugar modifications. Unless otherwise indicated, all modifications are independent of nucleobase sequence.

E. Certain Populations of Modified Oligonucleotides

Populations of modified oligonucleotides in which all of the modified oligonucleotides of the population have the same molecular formula can be stereorandom populations or chirally enriched populations. All of the chiral centers of all of the modified oligonucleotides are stereorandom in a stereorandom population. In a chirally enriched population, at least one particular chiral center is not stereorandom in the modified oligonucleotides of the population. In certain embodiments, the modified oligonucleotides of a chirally enriched population are enriched for β-D ribosyl sugar moieties, and all of the phosphorothioate internucleoside linkages are stereorandom. In certain embodiments, the modified oligonucleotides of a chirally enriched population are enriched for both β-D ribosyl sugar moieties and at least one, particular phosphorothioate internucleoside linkage in a particular stereochemical configuration.

F. Nucleobase Sequence

In certain embodiments, oligonucleotides (unmodified or modified oligonucleotides) are further described by their nucleobase sequence. In certain embodiments oligonucleotides have a nucleobase sequence that is complementary to a second oligonucleotide or an identified reference nucleic acid, such as a target nucleic acid. In certain such embodiments, a region of an oligonucleotide has a nucleobase sequence that is complementary to a second oligonucleotide or an identified reference nucleic acid, such as a target nucleic acid. In certain embodiments, the nucleobase sequence of a region or entire length of an oligonucleotide is at least 50%, at least 60%, at least 70%, at least 80%, at least 85%, at least 90%, at least 95%, or 100% complementary to the second oligonucleotide or nucleic acid, such as a target nucleic acid.

II. Certain Oligomeric Compounds

In certain embodiments, provided herein are oligomeric compounds, which consist of an oligonucleotide (modified or unmodified) and optionally one or more conjugate groups and/or terminal groups. Conjugate groups consist of one or more conjugate moiety and a conjugate linker which links the conjugate moiety to the oligonucleotide. Conjugate groups may be attached to either or both ends of an oligonucleotide and/or at any internal position. In certain embodiments, conjugate groups are attached to the 2'-position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups (or terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

Examples of terminal groups include but are not limited to conjugate groups, capping groups, phosphate moieties, protecting groups, modified or unmodified nucleosides, and two or more nucleosides that are independently modified or unmodified.

A. Certain Conjugate Groups

In certain embodiments, oligonucleotides are covalently attached to one or more conjugate groups. In certain embodiments, conjugate groups modify one or more properties of the attached oligonucleotide, including but not limited to pharmacodynamics, pharmacokinetics, stability, binding, absorption, tissue distribution, cellular distribution, cellular uptake, charge and clearance. In certain embodiments, conjugate groups impart a new property on the attached oligonucleotide, e.g., fluorophores or reporter groups that enable detection of the oligonucleotide. Certain conjugate groups and conjugate moieties have been described previously, for example: cholesterol moiety (Letsinger et al., Proc. Natl. Acad. Sci. USA, 1989, 86, 6553-6556), cholic acid (Manoharan et al., Bioorg. Med. Chem. Lett., 1994, 4, 1053-1060), a thioether, e.g., hexyl-S-tritylthiol (Manoharan et al., Ann. N.Y. Acad. Sci., 1992, 660, 306-309; Manoharan et al., Bioorg. Med. Chem. Lett., 1993, 3, 2765-2770), a thiocholesterol (Oberhauser et al., Nucl. Acids Res., 1992, 20, 533-538), an aliphatic chain, e g., do-decan-diol or undecyl residues (Saison-Behmoaras et al., EMBO J., 1991, 10, 1111-1118; Kabanov et al., FEBS Lett., 1990, 259, 327-330; Svinarchuk et al., Biochimie, 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., Tetrahedron Lett., 1995, 36, 3651-3654; Shea et al., Nucl. Acids Res., 1990, 18, 3777-3783), a polyamine or a polyethylene glycol chain (Manoharan et al., Nucleosides & Nucleotides, 1995, 14, 969-973), or adamantane acetic acid a palmityl moiety (Mishra et al., Biochim. Biophys. Acta, 1995, 1264, 229-237), an octadecylamine or hexylamino-carbonyl-oxycholesterol moiety (Crooke et al., J. Pharmacol. Exp. Ther., 1996, 277, 923-937), a tocopherol group (Nishina et al., Molecular Therapy Nucleic Acids, 2015, 4, e220; and Nishina et al., Molecular Therapy, 2008, 16, 734-740), or a GalNAc cluster (e.g., WO2014/179620).

1. Conjugate Moieties

Conjugate moieties include, without limitation, intercalators, reporter molecules, polyamines, polyamides, peptides, carbohydrates, vitamin moieties, polyethylene glycols, thioethers, polyethers, cholesterols, thiocholesterols, cholic acid moieties, folate, lipids, phospholipids, biotin, phenazine, phenanthridine, anthraquinone, adamantane, acridine, fluoresceins, rhodamines, coumarins, fluorophores, and dyes.

In certain embodiments, a conjugate moiety comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indomethicin, a barbiturate, a cephalosporin, a sulfa drug, an antidiabetic, an antibacterial or an antibiotic.

2. Conjugate Linkers

Conjugate moieties are attached to oligonucleotides through conjugate linkers. In certain oligomeric compounds, the conjugate linker is a single chemical bond (i.e., the conjugate moiety is attached directly to an oligonucleotide through a single bond). In certain embodiments, the conjugate linker comprises a chain structure, such as a hydrocarbyl chain, or an oligomer of repeating units such as ethylene glycol, nucleosides, or amino acid units.

In certain embodiments, a conjugate linker comprises one or more groups selected from alkyl, amino, oxo, amide, disulfide, polyethylene glycol, ether, thioether, and hydroxylamino. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate linkers described above, are bifunctional linking moieties, e.g., those known in the art to be useful for attaching conjugate groups to parent compounds, such as the oligonucleotides provided herein. In general, a bifunctional linking moiety comprises at least two functional groups. One of the functional groups is selected to react with to a particular site on a parent compound and the other is selected to react with to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are not limited to pyrrolidine, 8-amino-3,6-dioxaoctanoic acid (ADO), succinimidyl 4-(N-maleimidomethyl) cyclohexane-1-carboxylate (SMCC) and 6-aminohexanoic acid (AHEX or AHA). Other conjugate linkers include but are not limited to substituted or unsubstituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, conjugate linkers comprise 1-10 linker-nucleosides. In certain embodiments, conjugate linkers comprise 2-5 linker-nucleosides. In certain embodiments, conjugate linkers comprise exactly 3 linker-nucleosides. In certain embodiments, conjugate linkers comprise the TCA motif. In certain embodiments, such linker-nucleosides are modified nucleosides. In certain embodiments such linker-nucleosides comprise a modified sugar moiety. In certain embodiments, linker-nucleosides are unmodified. In certain embodiments, linker-nucleosides comprise an optionally protected heterocyclic base selected from a purine, substituted purine, pyrimidine or substituted pyrimidine. In certain embodiments, a cleavable moiety is a nucleoside selected from uracil, thymine, cytosine, 4-N-benzoylcytosine, 5-methyl cytosine, 4-N-benzoyl-5-methyl cytosine, adenine, 6-N-benzoyladenine, guanine and 2-N-isobutyrylguanine. It is typically desirable for linker-nucleosides to be cleaved from the oligomeric compound after it reaches a target tissue. Accordingly, linker-nucleosides are typically linked to one another and to the remainder of the oligomeric compound through cleavable bonds. In certain embodiments, such cleavable bonds are phosphodiester bonds.

Herein, linker-nucleosides are not considered to be part of the oligonucleotide. Accordingly, in embodiments in which an oligomeric compound comprises an oligonucleotide consisting of a specified number or range of linked nucleosides and/or a specified percent complementarity to a reference nucleic acid and the oligomeric compound also comprises a conjugate group comprising a conjugate linker comprising linker-nucleosides, those linker-nucleosides are not counted toward the length of the oligonucleotide and are not used in determining the percent complementarity of the oligonucleotide for the reference nucleic acid. For example, an oligomeric compound may comprise (1) a modified oligonucleotide consisting of 8-30 nucleosides and (2) a conjugate group comprising 1-10 linker-nucleosides that are contiguous with the nucleosides of the modified oligonucleotide. The total number of contiguous linked nucleosides in such an oligomeric compound is more than 30. Alternatively, an oligomeric compound may comprise a modified oligonucleotide consisting of 8-30 nucleosides and no conjugate group. The total number of contiguous linked nucleosides in such an oligomeric compound is no more than 30. Unless otherwise indicated conjugate linkers comprise no more than 10 linker-nucleosides. In certain embodiments, conjugate linkers comprise no more than 5 linker-nucleosides. In certain embodiments, conjugate linkers comprise no more than 3 linker-nucleosides. In certain embodiments, conjugate linkers comprise no more than 2 linker-nucleosides. In certain embodiments, conjugate linkers comprise no more than 1 linker-nucleoside.

In certain embodiments, it is desirable for a conjugate group to be cleaved from the oligonucleotide. For example, in certain circumstances oligomeric compounds comprising a particular conjugate moiety are better taken up by a particular cell type, but once the oligomeric compound has been taken up, it is desirable that the conjugate group be cleaved to release the unconjugated or parent oligonucleotide. Thus, certain conjugate linkers may comprise one or more cleavable moieties. In certain embodiments, a cleavable moiety is a cleavable bond. In certain embodiments, a cleavable moiety is a group of atoms comprising at least one cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome. In certain embodiments, a cleavable moiety is selectively cleaved by endogenous enzymes, such as nucleases.

In certain embodiments, a cleavable bond is selected from among: an amide, an ester, an ether, one or both esters of a phosphodiester, a phosphate ester, a carbamate, or a disulfide. In certain embodiments, a cleavable bond is one or both of the esters of a phosphodiester. In certain embodiments, a cleavable moiety comprises a phosphate or phosphodiester. In certain embodiments, the cleavable moiety is a phosphate linkage between an oligonucleotide and a conjugate moiety or conjugate group.

In certain embodiments, a cleavable moiety comprises or consists of one or more linker-nucleosides. In certain such embodiments, the one or more linker-nucleosides are linked to one another and/or to the remainder of the oligomeric compound through cleavable bonds. In certain embodiments, such cleavable bonds are unmodified phosphodiester bonds. In certain embodiments, a cleavable moiety is 2'-deoxy nucleoside that is attached to either the 3' or 5'-terminal nucleoside of an oligonucleotide by a phosphate internucleoside linkage and covalently attached to the remainder of the conjugate linker or conjugate moiety by a phosphate or phosphorothioate linkage. In certain such embodiments, the cleavable moiety is 2'-deoxyadenosine.

B. Certain Terminal Groups

In certain embodiments, oligomeric compounds comprise one or more terminal groups. In certain such embodiments, oligomeric compounds comprise a stabilized 5'-phosphate. Stabilized 5'-phosphates include, but are not limited to 5'-phosphanates, including, but not limited to 5'-vinylphosphonates. In certain embodiments, terminal groups comprise one or more abasic nucleosides and/or inverted nucleosides. In certain embodiments, terminal groups comprise one or more 2'-linked nucleosides. In certain such embodiments, the 2'-linked nucleoside is an abasic nucleoside.

III. Oligomeric Duplexes

In certain embodiments, oligomeric compounds described herein comprise an oligonucleotide, having a nucleobase sequence complementary to that of a target nucleic acid. In certain embodiments, an oligomeric compound is paired with a second oligomeric compound to form an oligomeric duplex. Such oligomeric duplexes comprise a first oligomeric compound having a region complementary to a target nucleic acid and a second oligomeric compound having a region complementary to the first oligomeric compound. In certain embodiments, the first oligomeric compound of an oligomeric duplex comprises or consists of (1) a modified or unmodified oligonucleotide and optionally a conjugate group and (2) a second modified or unmodified oligonucleotide and optionally a conjugate group. Either or both oligomeric compounds of an oligomeric duplex may comprise a conjugate group. The oligonucleotides of each oligomeric compound of an oligomeric duplex may include non-complementary overhanging nucleosides.

IV. Antisense Activity

In certain embodiments, oligomeric compounds and oligomeric duplexes are capable of hybridizing to a target nucleic acid, resulting in at least one antisense activity; such oligomeric compounds and oligomeric duplexes are antisense compounds. In certain embodiments, antisense compounds have antisense activity when they reduce or inhibit the amount or activity of a target nucleic acid by 25% or more in the standard cell assay. In certain embodiments, antisense compounds selectively affect one or more target nucleic acid. Such antisense compounds comprise a nucleobase sequence that hybridizes to one or more target nucleic acid, resulting in one or more desired antisense activity and does not hybridize to one or more non-target nucleic acid or does not hybridize to one or more non-target nucleic acid in such a way that results in significant undesired antisense activity.

In certain antisense activities, hybridization of an antisense compound to a target nucleic acid results in recruitment of a protein that cleaves the target nucleic acid. For example, certain antisense compounds result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, described herein are antisense compounds that are sufficiently "DNA-like" to elicit RNase H activity. In certain embodiments, one or more non-DNA-like nucleoside in the gap of a gapmer is tolerated.

In certain antisense activities, an antisense compound or a portion of an antisense compound is loaded into an RNA-induced silencing complex (RISC), ultimately resulting in cleavage of the target nucleic acid. For example, certain antisense compounds result in cleavage of the target nucleic acid by Argonaute. Antisense compounds that are loaded into RISC are RNAi compounds. RNAi compounds may be double-stranded (siRNA) or single-stranded (ssRNA).

In certain embodiments, hybridization of an antisense compound to a target nucleic acid does not result in recruitment of a protein that cleaves that target nucleic acid. In certain embodiments, hybridization of the antisense compound to the target nucleic acid results in alteration of splicing of the target nucleic acid. In certain embodiments, hybridization of an antisense compound to a target nucleic acid results in inhibition of a binding interaction between the target nucleic acid and a protein or other nucleic acid. In certain embodiments, hybridization of an antisense compound to a target nucleic acid results in alteration of translation of the target nucleic acid.

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein and/or a phenotypic change in a cell or animal.

V. Certain Target Nucleic Acids

In certain embodiments, oligomeric compounds comprise or consist of an oligonucleotide comprising a region that is complementary to a target nucleic acid. In certain embodiments, the target nucleic acid is an endogenous RNA molecule. In certain embodiments, the target nucleic acid encodes a protein. In certain such embodiments, the target nucleic acid is selected from: a mature mRNA and a pre-mRNA, including intronic, exonic and untranslated regions. In certain embodiments, the target RNA is a mature mRNA. In certain embodiments, the target nucleic acid is a pre-mRNA. In certain such embodiments, the target region is entirely within an intron. In certain embodiments, the target region spans an intron/exon junction. In certain embodiments, the target region is at least 50% within an intron. In certain embodiments, the target nucleic acid is the RNA transcriptional product of a retrogene. In certain embodiments, the target nucleic acid is a non-coding RNA. In certain such embodiments, the target non-coding RNA is selected from: a long non-coding RNA, a short non-coding RNA, an intronic RNA molecule.

A. Complementarity/Mismatches to the Target Nucleic Acid

It is possible to introduce mismatch bases without eliminating activity. For example, Gautschi et al (J. Natl. Cancer Inst. 93:463-471, March 2001) demonstrated the ability of an oligonucleotide having 100% complementarity to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo. Maher and Dolnick (Nuc. Acid. Res. 16:3341-3358, 1988) tested a series of tandem 14 nucleobase oligonucleotides, and a 28 and 42 nucleobase oligonucleotides comprised of the sequence of two or three of the tandem oligonucleotides, respectively, for their ability to arrest translation of human DHFR in a rabbit reticulocyte assay. Each of the three 14 nucleobase oligonucleotides alone was able to inhibit translation, albeit at a more modest level than the 28 or 42 nucleobase oligonucleotides.

In certain embodiments, oligonucleotides are complementary to the target nucleic acid over the entire length of the oligonucleotide. In certain embodiments, oligonucleotides are 99%, 95%, 90%, 85%, or 80% complementary to the target nucleic acid. In certain embodiments, oligonucleotides are at least 80% complementary to the target nucleic acid over the entire length of the oligonucleotide and comprise a region that is 100% or fully complementary to a target nucleic acid. In certain embodiments, the region of full complementarity is from 6 to 20, 10 to 18, or 18 to 20 nucleobases in length.

In certain embodiments, oligonucleotides comprise one or more mismatched nucleobases relative to the target nucleic acid. In certain embodiments, antisense activity against the target is reduced by such mismatch, but activity against a non-target is reduced by a greater amount. Thus, in certain embodiments selectivity of the oligonucleotide is improved. In certain embodiments, the mismatch is specifically positioned within an oligonucleotide having a gapmer motif. In certain embodiments, the mismatch is at position 1, 2, 3, 4, 5, 6, 7, or 8 from the 5'-end of the gap region. In certain embodiments, the mismatch is at position 9, 8, 7, 6, 5, 4, 3, 2, 1 from the 3'-end of the gap region. In certain embodiments, the mismatch is at position 1, 2, 3, or 4 from the 5'-end of the wing region. In certain embodiments, the mismatch is at position 4, 3, 2, or 1 from the 3'-end of the wing region.

B. ATXN2

In certain embodiments, oligomeric compounds comprise or consist of an oligonucleotide comprising a region that is complementary to a target nucleic acid, wherein the target nucleic acid is ATXN2. In certain embodiments, ATXN2 nucleic acid has the sequence set forth in SEQ ID NO: 1 (GENBANK Accession No: NM_002973.3) and SEQ ID NO: 2 (the complement of GENBANK Accession No: NT_009775.17 truncated from nucleotides 2465000 to 2616000).

In certain embodiments, contacting a cell with an oligomeric compound complementary to SEQ ID NO: 1 or SEQ ID NO: 2 reduces the amount of ATXN2 mRNA, and in certain embodiments reduces the amount of Ataxin-2 protein. In certain embodiments, the oligomeric compound consists of a modified oligonucleotide. In certain embodiments, contacting a cell with an oligomeric compound complementary to SEQ ID NO: 1 or SEQ ID NO: 2 ameliorates one or more symptom or hallmark of a neurodegenerative disease. In certain embodiments, the oligomeric compound consists of a modified oligonucleotide. In certain embodiments, the symptom or hallmark is ataxia, neuropathy, or aggregate formation. In certain embodiments, contacting a cell with a modified oligonucleotide complementary to SEQ ID NO: 1 or SEQ ID NO: 2 results in improved motor function, reduced neuropathy, and reduction in number of aggregates. In certain embodiments, the oligomeric compound consists of a modified oligonucleotide.

C. Certain Target Nucleic Acids in Certain Tissues

In certain embodiments, oligomeric compounds comprise or consist of an oligonucleotide comprising a region that is complementary to a target nucleic acid, wherein the target nucleic acid is expressed in a pharmacologically relevant tissue. In certain embodiments, the pharmacologically relevant tissues are the cells and tissues that comprise the central nervous system (CNS). Such tissues include brain tissues, such as, cortex, spinal cord, hippocampus, pons, cerebellum, substantia nigra, red nucleus, medulla, thalamus, and dorsal root ganglia.

VI. Certain Pharmaceutical Compositions

In certain embodiments, described herein are pharmaceutical compositions comprising one or more oligomeric compounds. In certain embodiments, the one or more oligomeric compounds each consists of a modified oligonucleotide. In certain embodiments, the pharmaceutical composition comprises a pharmaceutically acceptable diluent or carrier. In certain embodiments, a pharmaceutical composition comprises or consists of a sterile saline solution and one or more oligomeric compound. In certain embodiments, the sterile saline is pharmaceutical grade saline. In certain embodiments, a pharmaceutical composition comprises or consists of one or more oligomeric compound and sterile water. In certain embodiments, the sterile water is pharmaceutical grade water. In certain embodiments, a pharmaceutical composition comprises or consists of one or more oligomeric compound and phosphate-buffered saline (PBS). In certain embodiments, the sterile PBS is pharmaceutical grade PBS. In certain embodiments, a pharmaceutical composition comprises or consists of one or more oligomeric compound and artificial cerebrospinal fluid. In certain embodiments, the artificial cerebrospinal fluid is pharmaceutical grade.

In certain embodiments, a pharmaceutical composition comprises a modified oligonucleotide and artificial cerebrospinal fluid. In certain embodiments, a pharmaceutical composition consists of a modified oligonucleotide and artificial cerebrospinal fluid. In certain embodiments, a pharmaceutical composition consists essentially of a modified oligonucleotide and artificial cerebrospinal fluid. In certain embodiments, the artificial cerebrospinal fluid is pharmaceutical grade.

In certain embodiments, pharmaceutical compositions comprise one or more oligomeric compound and one or more excipients. In certain embodiments, excipients are selected from water, salt solutions, alcohol, polyethylene glycols, gelatin, lactose, amylase, magnesium stearate, talc, silicic acid, viscous paraffin, hydroxymethylcellulose and polyvinylpyrrolidone.

In certain embodiments, oligomeric compounds may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease, or dose to be administered.

In certain embodiments, pharmaceutical compositions comprising an oligomeric compound encompass any pharmaceutically acceptable salts of the oligomeric compound, esters of the oligomeric compound, or salts of such esters. In certain embodiments, pharmaceutical compositions comprising oligomeric compounds comprising one or more oligonucleotide, upon administration to an animal, including a human, are capable of providing (directly or indirectly) the biologically active metabolite or residue thereof. Accordingly, for example, the disclosure is also drawn to pharmaceutically acceptable salts of oligomeric compounds, prodrugs, pharmaceutically acceptable salts of such prodrugs, and other bioequivalents. Suitable pharmaceutically acceptable salts include, but are not limited to, sodium and potassium salts. In certain embodiments, prodrugs comprise one or more conjugate group attached to an oligonucleotide, wherein the conjugate group is cleaved by endogenous nucleases within the body.

Lipid moieties have been used in nucleic acid therapies in a variety of methods. In certain such methods, the nucleic acid, such as an oligomeric compound, is introduced into preformed liposomes or lipoplexes made of mixtures of cationic lipids and neutral lipids. In certain methods, DNA complexes with mono- or poly-cationic lipids are formed without the presence of a neutral lipid. In certain embodiments, a lipid moiety is selected to increase distribution of a pharmaceutical agent to a particular cell or tissue. In certain embodiments, a lipid moiety is selected to increase distribution of a pharmaceutical agent to fat tissue. In certain embodiments, a lipid moiety is selected to increase distribution of a pharmaceutical agent to muscle tissue.

In certain embodiments, pharmaceutical compositions comprise a delivery system. Examples of delivery systems include, but are not limited to, liposomes and emulsions. Certain delivery systems are useful for preparing certain pharmaceutical compositions including those comprising hydrophobic compounds. In certain embodiments, certain organic solvents such as dimethylsulfoxide are used.

In certain embodiments, pharmaceutical compositions comprise one or more tissue-specific delivery molecules designed to deliver the one or more pharmaceutical agents of the present invention to specific tissues or cell types. For example, in certain embodiments, pharmaceutical compositions include liposomes coated with a tissue-specific antibody.

In certain embodiments, pharmaceutical compositions comprise a co-solvent system. Certain of such co-solvent systems comprise, for example, benzyl alcohol, a nonpolar surfactant, a water-miscible organic polymer, and an aqueous phase. In certain embodiments, such co-solvent systems are used for hydrophobic compounds. A non-limiting example of such a co-solvent system is the VPD co-solvent system, which is a solution of absolute ethanol comprising 3% w/v benzyl alcohol, 8% w/v of the nonpolar surfactant Polysorbate 80™ and 65% w/v polyethylene glycol 300. The proportions of such co-solvent systems may be varied considerably without significantly altering their solubility and toxicity characteristics. Furthermore, the identity of co-solvent components may be varied: for example, other surfactants may be used instead of Polysorbate 80™; the fraction size of polyethylene glycol may be varied; other biocompatible polymers may replace polyethylene glycol, e.g., polyvinyl pyrrolidone; and other sugars or polysaccharides may substitute for dextrose.

In certain embodiments, pharmaceutical compositions are prepared for oral administration. In certain embodiments, pharmaceutical compositions are prepared for buccal administration. In certain embodiments, a pharmaceutical composition is prepared for administration by injection (e.g., intravenous, subcutaneous, intramuscular, intrathecal (IT), intracerebroventricular (ICV), etc.). In certain of such embodiments, a pharmaceutical composition comprises a carrier and is formulated in aqueous solution, such as water or physiologically compatible buffers such as Hanks's solution, Ringer's solution, or physiological saline buffer. In certain embodiments, other ingredients are included (e.g., ingredients that aid in solubility or serve as preservatives). In certain embodiments, injectable suspensions are prepared using appropriate liquid carriers, suspending agents and the like. Certain pharmaceutical compositions for injection are presented in unit dosage form, e.g., in ampoules or in multi-dose containers. Certain pharmaceutical compositions for injection are suspensions, solutions or emulsions in oily or aqueous vehicles, and may contain formulatory agents such as suspending, stabilizing and/or dispersing agents. Certain solvents suitable for use in pharmaceutical compositions for injection include, but are not limited to, lipophilic solvents and fatty oils, such as sesame oil, synthetic fatty acid esters, such as ethyl oleate or triglycerides, and liposomes.

Under certain conditions, certain compounds disclosed herein act as acids. Although such compounds may be drawn or described in protonated (free acid) form, in ionized (anion) form, or ionized and in association with a cation (salt) form, aqueous solutions of such compounds exist in equilibrium among such forms. For example, a phosphate linkage of an oligonucleotide in aqueous solution exists in equilibrium among free acid, anion, and salt forms. Unless otherwise indicated, compounds described herein are intended to include all such forms. Moreover, certain oligonucleotides have several such linkages, each of which is in equilibrium. Thus, oligonucleotides in solution exist in an ensemble of forms at multiple positions all at equilibrium. The term "oligonucleotide" is intended to include all such forms. Drawn structures necessarily depict a single form. Nevertheless, unless otherwise indicated, such drawings are likewise intended to include corresponding forms. Herein, a structure depicting the free acid of a compound followed by the term "or salts thereof" expressly includes all such forms that may be fully or partially protonated/de-protonated/in association with a cation. In certain instances, one or more specific cation is identified.

In certain embodiments, oligomeric compounds disclosed herein are in aqueous solution with sodium. In certain embodiments, oligomeric compounds are in aqueous solution with potassium. In certain embodiments, oligomeric compounds are in artificial CSF. In certain embodiments, oligomeric compounds are in PBS. In certain embodiments, oligomeric compounds are in water. In certain such embodiments, the pH of the solution is adjusted with NaOH and/or HCl to achieve a desired pH.

VII. Certain Compositions

1. Compound No: 874218

Compound No: 874218 may be characterized as a 5-10-5 MOE gapmer, having a sequence of (from 5' to 3') GTACTTTTCTCATGTGCGGC (incorporated herein as SEQ ID NO: 1714), wherein each of nucleosides 1-5 and 16-20 (from 5' to 3') comprise a 2'-MOE modification and each of nucleosides 6-15 are 2'-deoxynucleosides, wherein the internucleoside linkages between nucleosides 2 to 3, 3 to 4, 4 to 5, 5 to 6, 16 to 17, and 17 to 18 are phosphodiester internucleoside linkages and the internucleoside linkages between nucleosides 1 to 2, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

Compound No: 780241 may be characterized by the following chemical notation: Ges Teo Aeo mCeo Teo Tds Tds Tds mCds Tds mCds Ads Tds Gds Tds Geo mCeo Ges Ges mCe; wherein, A=an adenine nucleobase,
mC=a 5-methyl cytosine nucleobase,
G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.

Compound No: 874218 may be represented by the following chemical structure:

SEQ ID NO: 1714
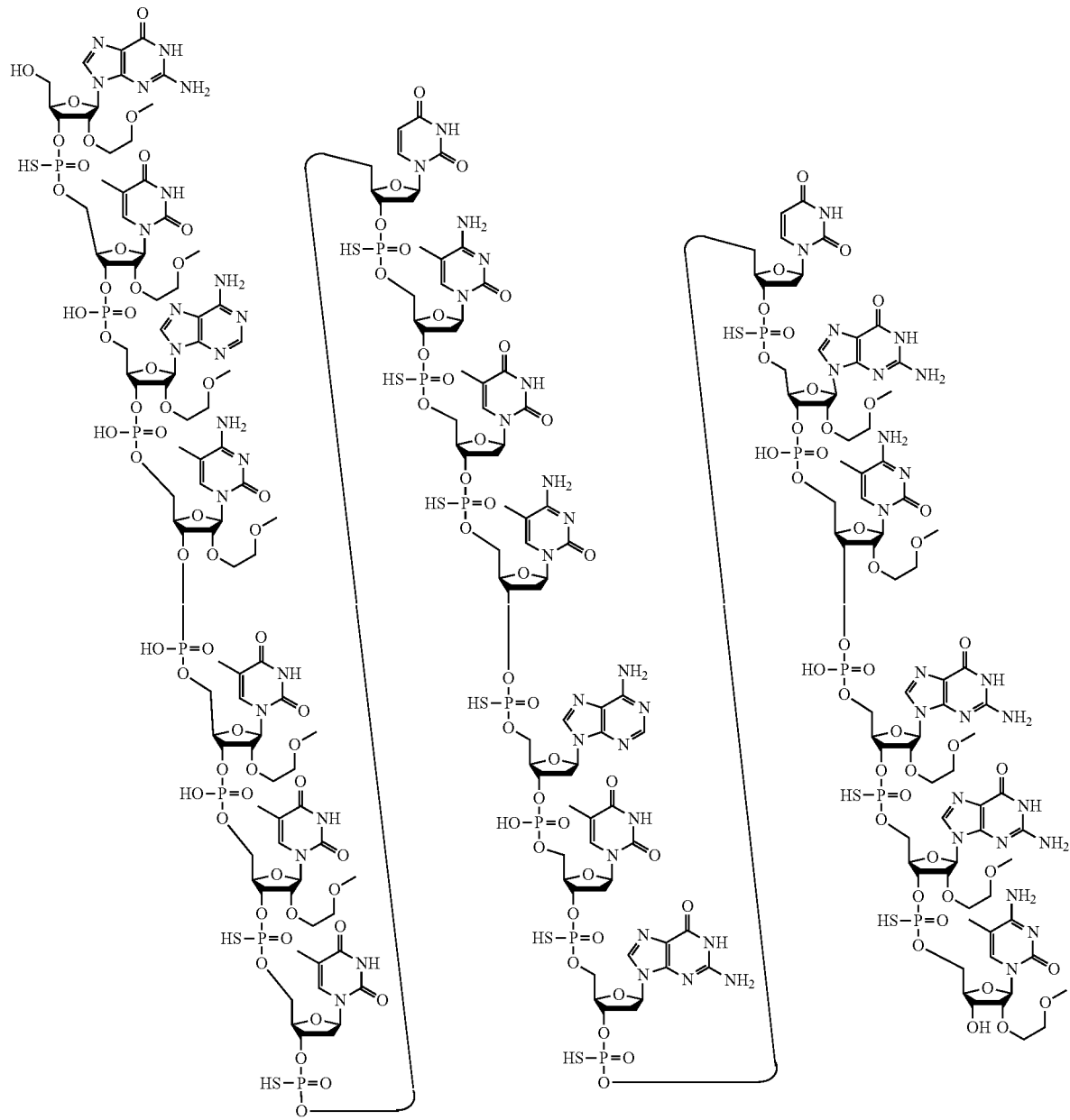
Structure 1. Compound No. 874218
In certain embodiments, the sodium salt of Compound No: 874218 may be represented by the following chemical structure:

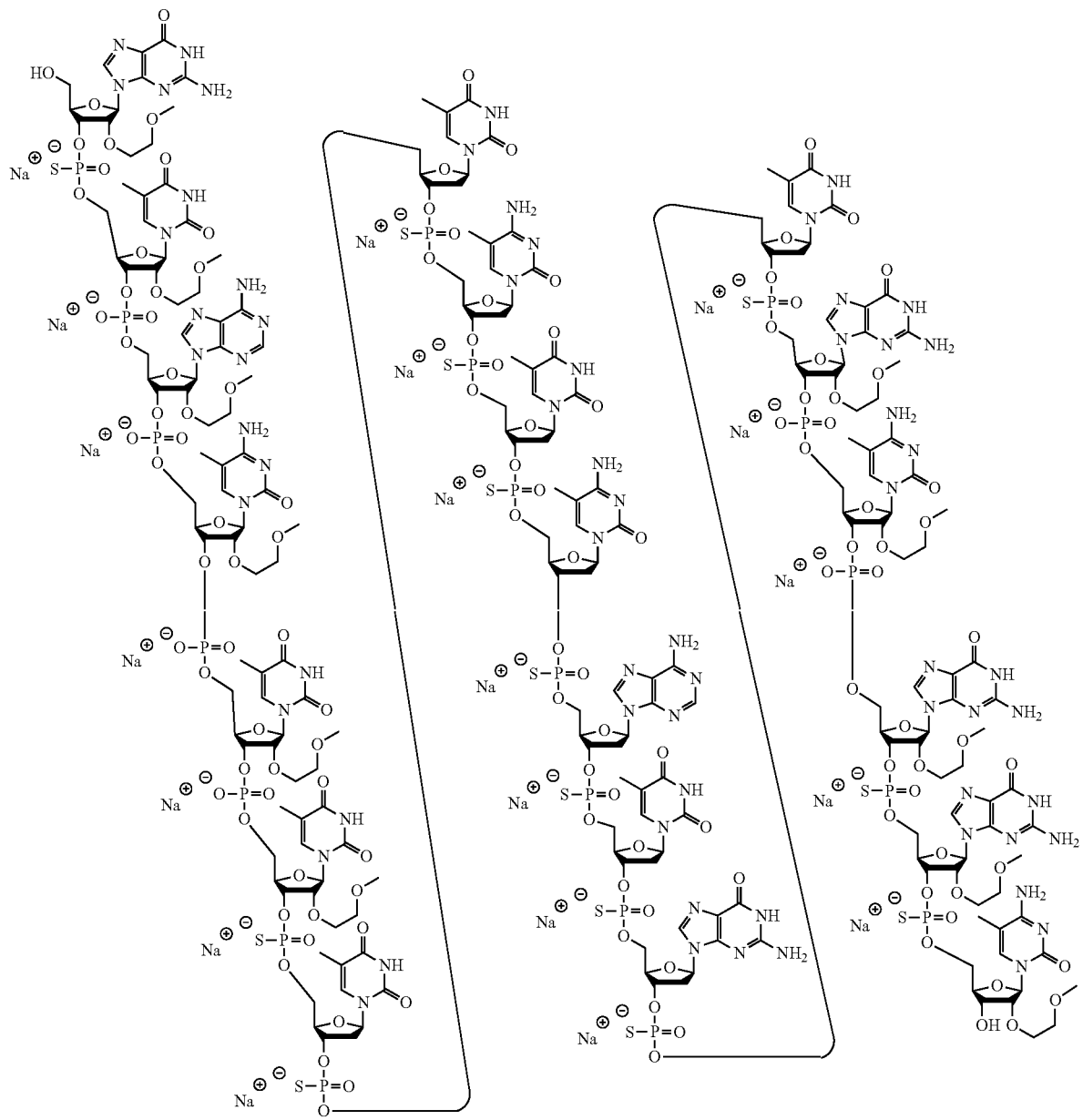

Structure 2. The Sodium Salt of Compound No. 874218

2. Compound No: 1008854

Compound No: 1008854 may be characterized as a 4-10-6 MOE gapmer, having a sequence of (from 5' to 3') CTGCTAACTGGTTTGCCCTT (incorporated herein as SEQ ID NO: 1255), wherein each of nucleosides 1-4 and 15-20 (from 5' to 3') comprise a 2'-MOE modification and each of nucleosides 5-14 are 2'-deoxynucleosides, wherein the internucleoside linkages between nucleosides 2 to 3, 3 to 4, 4 to 5, 15 to 16, 16 to 17, 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 18 to 19, and 19 to 20 are phosphorothioate internucleoside linkages, and wherein each cytosine is a 5-methyl cytosine.

Compound No: 1008854 may be characterized by the following chemical notation: mCes Teo Geo mCeo Tds Ads Ads mCds Tds Gds Gds Tds Tds Tds Geo mCeo mCeo mCes Tes Te; wherein, A=an adenine nucleobase, mC=a 5-methyl cytosine nucleobase, G=a guanine nucleobase, T=a thymine nucleobase, e=a 2'-MOE modified sugar, d=a 2'-deoxyribose sugar, s=a phosphorothioate internucleoside linkage, and o=a phosphodiester internucleoside linkage.

Compound No: 1008854 may be represented by the following chemical structure:

SEQ ID NO: 1255
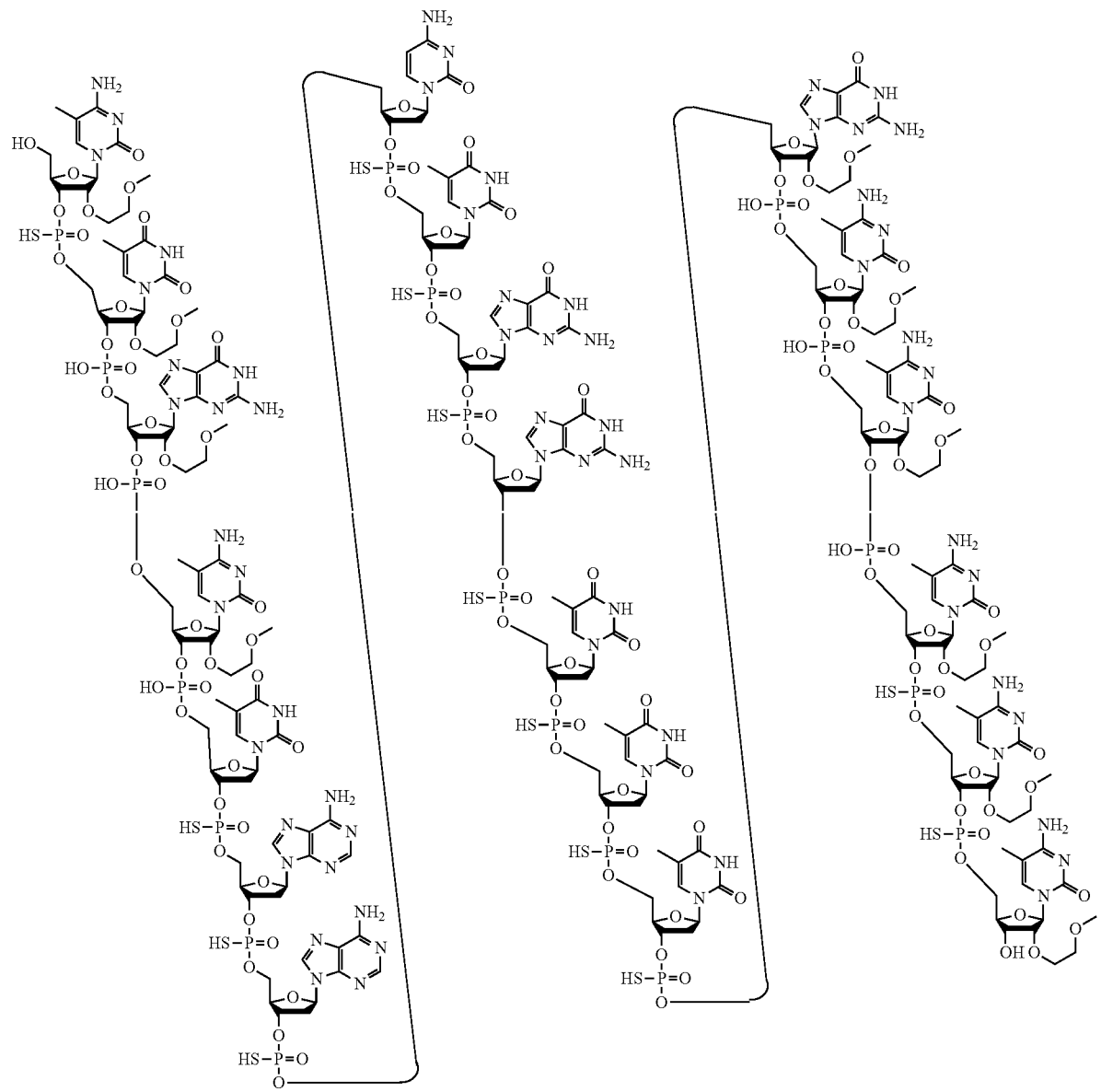
Structure 3. Compound No. 1008854
In certain embodiments, the sodium salt of Compound No: 1008854 may be represented by the following chemical structure:

SEQ ID NO: 1255

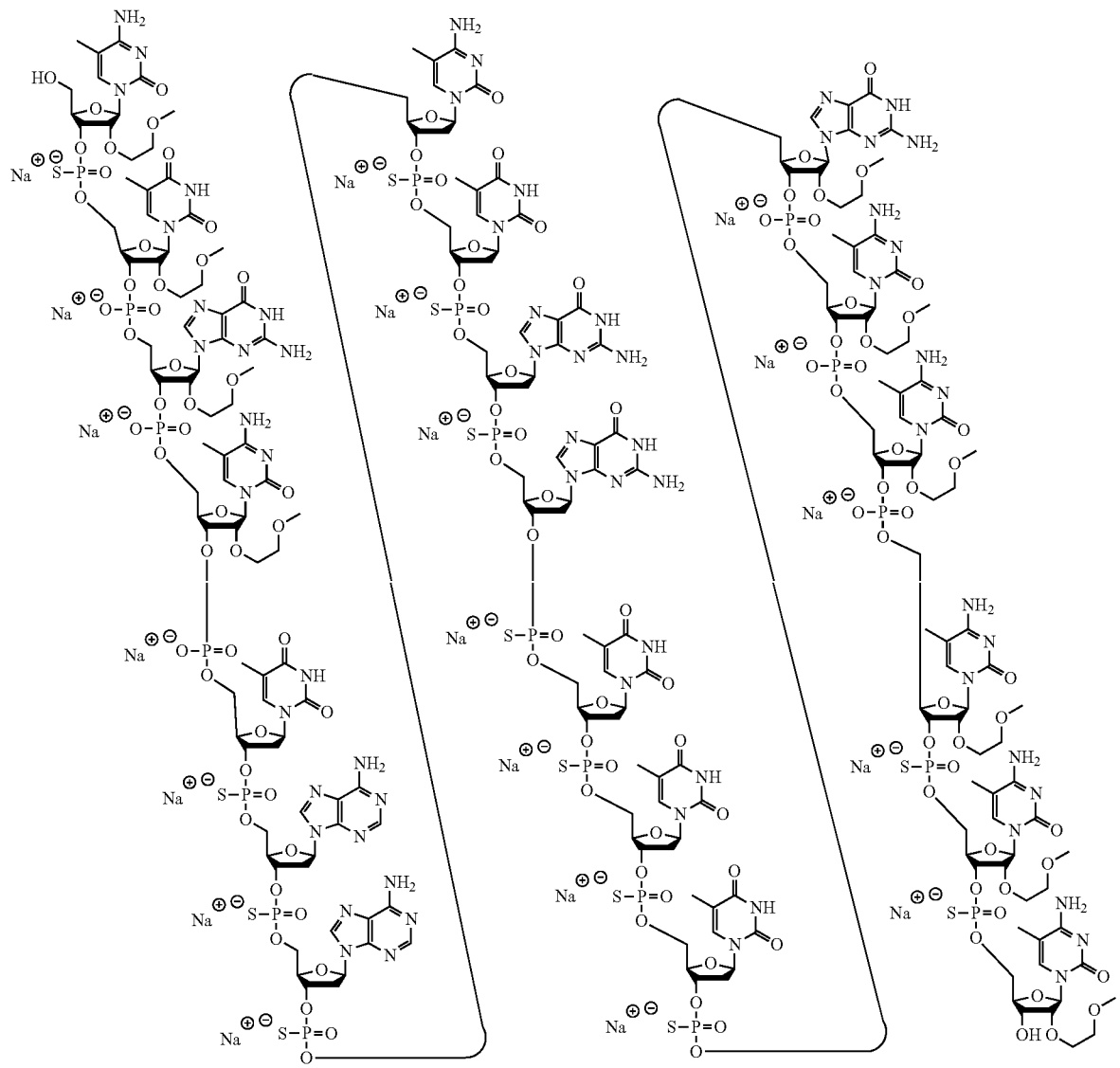

Structure 4. Sodium Salt of Compound No. 1008854

3. Compound No: 1008862

Compound No: 1008862 may be characterized as a 6-10-4 MOE gapmer, having a sequence of (from 5' to 3') TGTACTTCACATTTGGAGCC (incorporated herein as SEQ ID NO: 1185), wherein each of nucleosides 1-6 and 17-20 (from 5' to 3') comprise a 2'-MOE modification and each of nucleosides 7-16 are 2'-deoxynucleosides, wherein the internucleoside linkages between nucleosides 2 to 3, 3 to 4, 4 to 5, 5 to 6, 6 to 7, and 17 to 18 are phosphodiester internucleoside linkages and the internucleoside linkages between nucleosides 1 to 2, 7 to 8, 8 to 9, 9 to 10, 10 to 11, 11 to 12, 12 to 13, 13 to 14, 14 to 15, 15 to 16, 16 to 17, 18 to 19, and 19 to 20 are phosphorothioate internucleoside linkages, and wherein each cytosine is a 5-methyl cytosine.

Compound No: 1008862 may be characterized by the following chemical notation: Tes Geo Teo Aeo mCeo Teo Tds mCds Ads mCds Ads Tds Tds Tds Gds Gds Aeo Ges mCes mCe; wherein, A=an adenine nucleobase,
mC=a 5-methyl cytosine nucleobase,
G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.

Compound No: 1008862 may be represented by the following chemical structure:

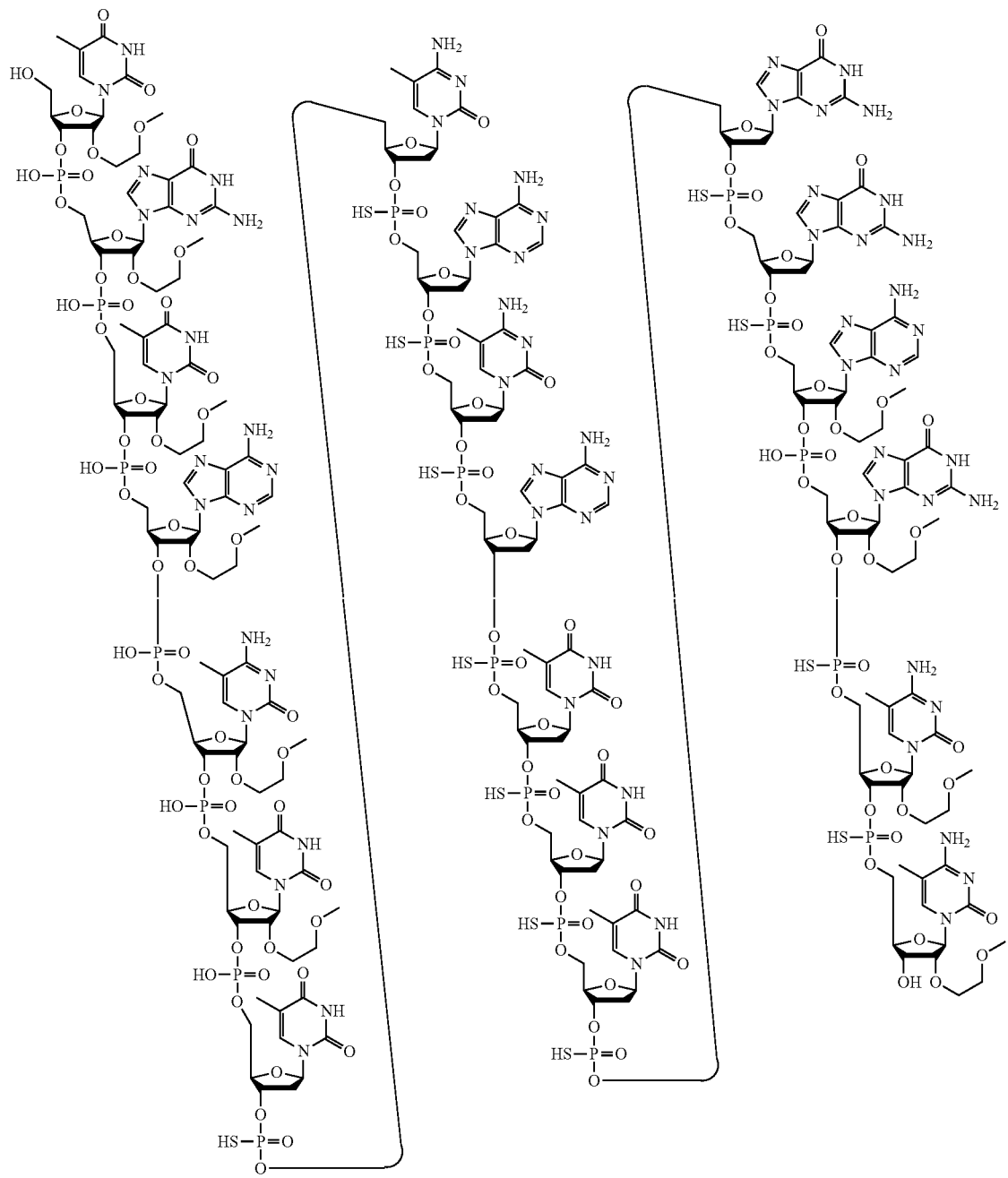
Structure 5. Compound No. 1008862
In certain embodiments, the sodium salt of Compound No: 1008862 may be represented by the following chemical structure:

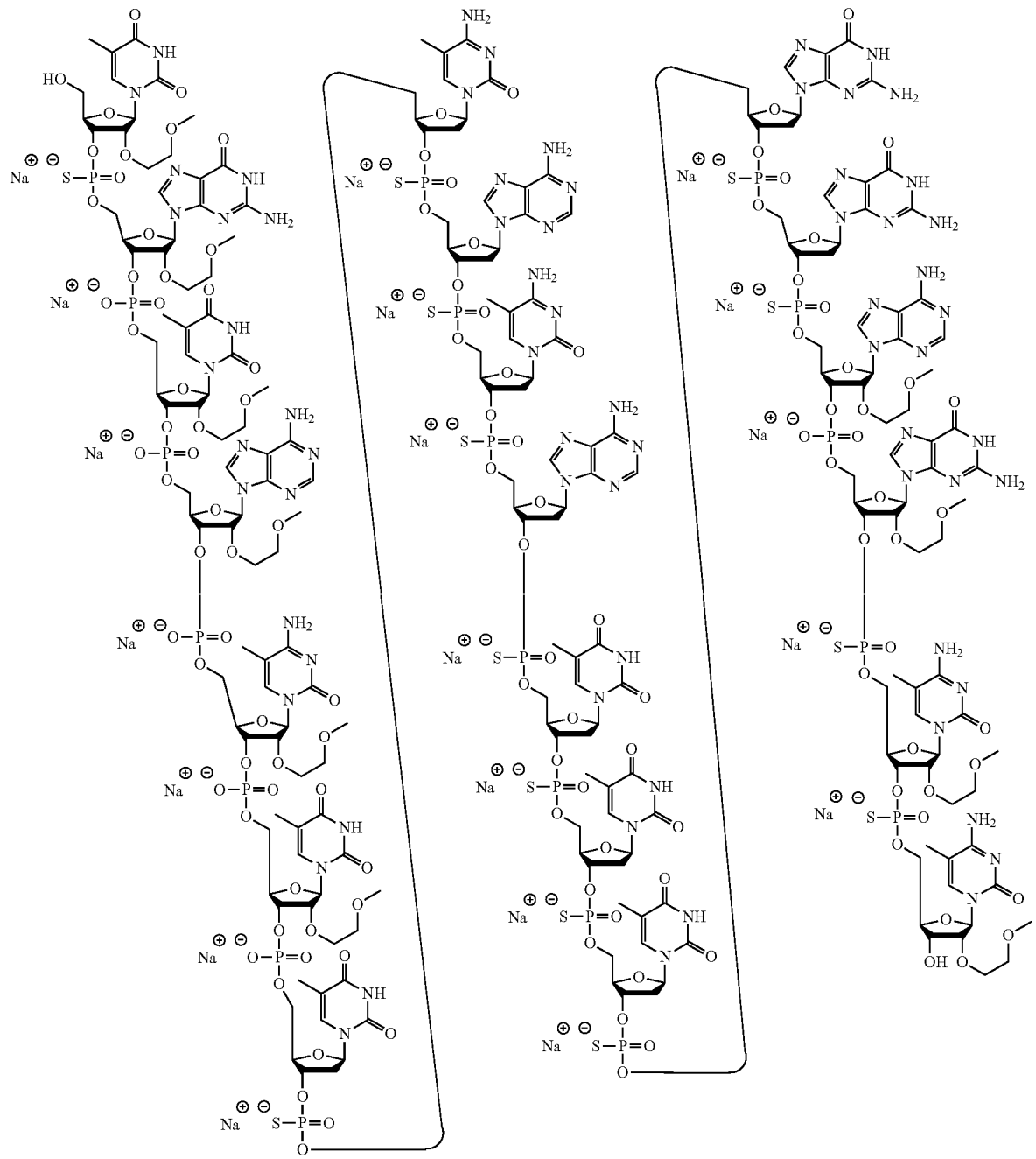

(SEQ ID NO:1185)

Structure 6. The Sodium Salt of Compound No. 1008862

4. Compound No: 1008870

Compound No: 1008870 may be characterized as a 6-10-4 MOE gapmer, having a sequence of (from 5' to 3') TGGAT-TCTGTACTTTTCTCA (incorporated herein as SEQ ID NO: 3235), wherein each of nucleosides 1-6 and 17-20 (from 5' to 3') comprise a 2'-MOE modification and each of nucleosides 7-16 are 2'-deoxynucleosides, wherein the internucleoside linkages between nucleosides 2 to 3, 3 to 4, 4 to 5, 5 to 6, 6 to 7, and 17 to 18, are phosphodiester internucleoside linkages and the internucleoside linkages between nucleosides 1 to 2, 7 to 8, 8 to 9, 9 to 10, 10 to 11, 11 to 12, 12 to 13, 13 to 14, 14 to 15, 15 to 16, 16 to 17, 18 to 19, and 19 to 20 are phosphorothioate internucleoside linkages, and wherein each cytosine is a 5-methyl cytosine.

Compound No: 1008870 may be characterized by the following chemical notation: Tes Geo Geo Aeo Teo Teo mCds Tds Gds Tds Ads mCds Tds Tds Tds Tds mCeo Tes mCes Ae; wherein, A=an adenine nucleobase,
mC=a 5-methyl cytosine nucleobase,
G=a guanine nucleobase,
T=a thymine nucleobase,
e=a 2'-MOE modified sugar, d=a 2'-deoxyribose sugar,
s=a phosphorothioate internucleoside linkage, and
o=a phosphodiester internucleoside linkage.
Compound No: 1008870 may be represented by the following chemical structure:
In certain embodiments, the sodium salt of Compound No: 1008870 may be represented by the following chemical structure:
SEQ ID NO: 3235
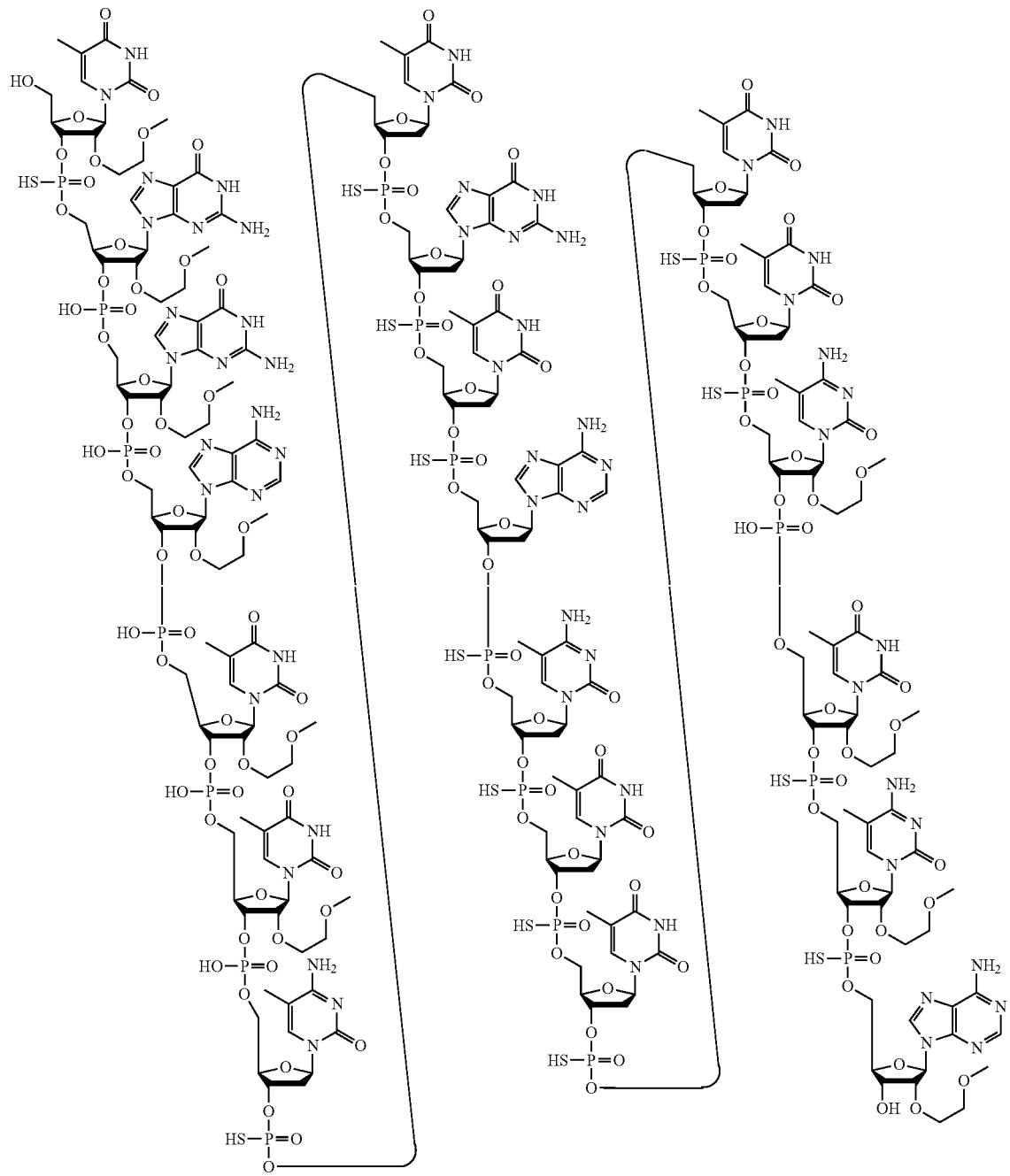
Structure 7. Compound No. 1008870

SEQ ID NO: 3235

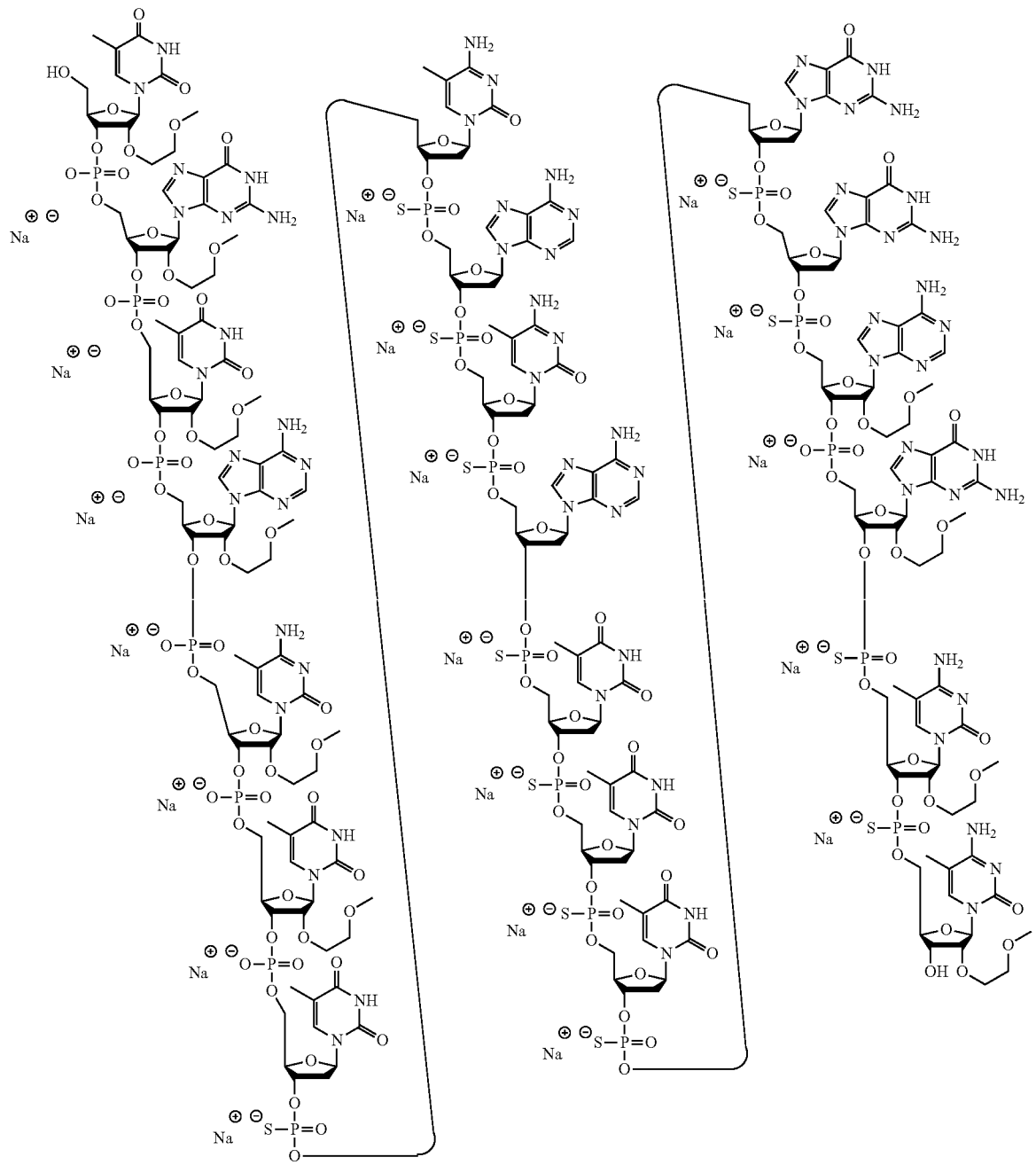

Structure 8. The Sodium salt of Compound No. 1008870
5. Compound No: 1008874

Compound No: 1008874 may be characterized as a 6-10-4 MOE gapmer, having a sequence of (from 5' to 3') CCTAT-CATCATTTTCCAGGG (incorporated herein as SEQ ID NO: 158), wherein each of nucleosides 1-6 and 17-20 (from 5' to 3') comprise a 2'-MOE modification and each of nucleosides 7-16 are 2'-deoxynucleosides, wherein the internucleoside linkages between nucleosides 2 to 3, 3 to 4, 4 to 5, 5 to 6, 6 to 7, and 17 to 18 are phosphodiester internucleoside linkages and the internucleoside linkages between nucleosides 1 to 2, 7 to 8, 8 to 9, 9 to 10, 10 to 11, 11 to 12, 12 to 13, 13 to 14, 14 to 15, 15 to 16, 16 to 17, 18 to 19, and 19 to 20 are phosphorothioate internucleoside linkages, and wherein each cytosine is a 5-methyl cytosine.

Compound No: 1008874 may be characterized by the following chemical notation: mCes mCeo Teo Aeo Teo mCeo Ads Tds mCds Ads Tds Tds Tds Tds mCds mCds Aeo Ges Ges Ge; wherein, A=an adenine nucleobase,
mC=a 5-methyl cytosine nucleobase,
G=a guanine nucleobase,
T=a thymine nucleobase,
e=a 2'-MOE modified sugar,
d=a 2'-deoxyribose sugar,
s=a phosphorothioate internucleoside linkage, and o=a phosphodiester internucleoside linkage.
Compound No: 1008874 may be represented by the following chemical structure:
In certain embodiments, the sodium salt of Compound No: 1008874 may be represented by the following chemical structure:
SEQ ID NO: 158
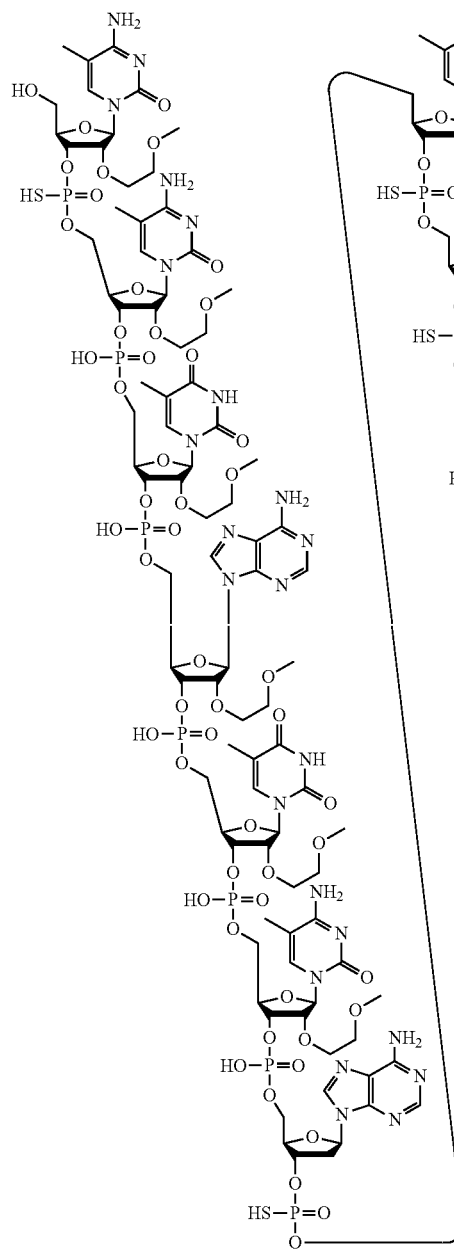
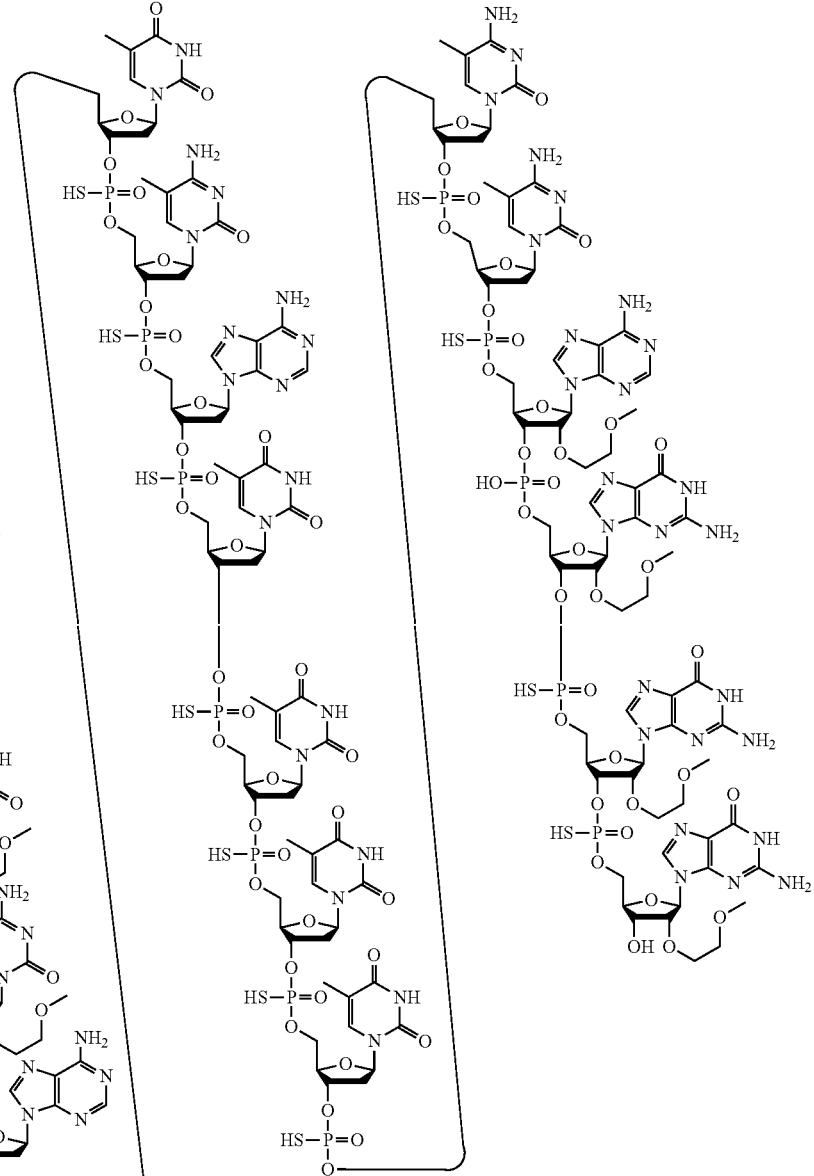
Structure 9. Compound No. 1008874

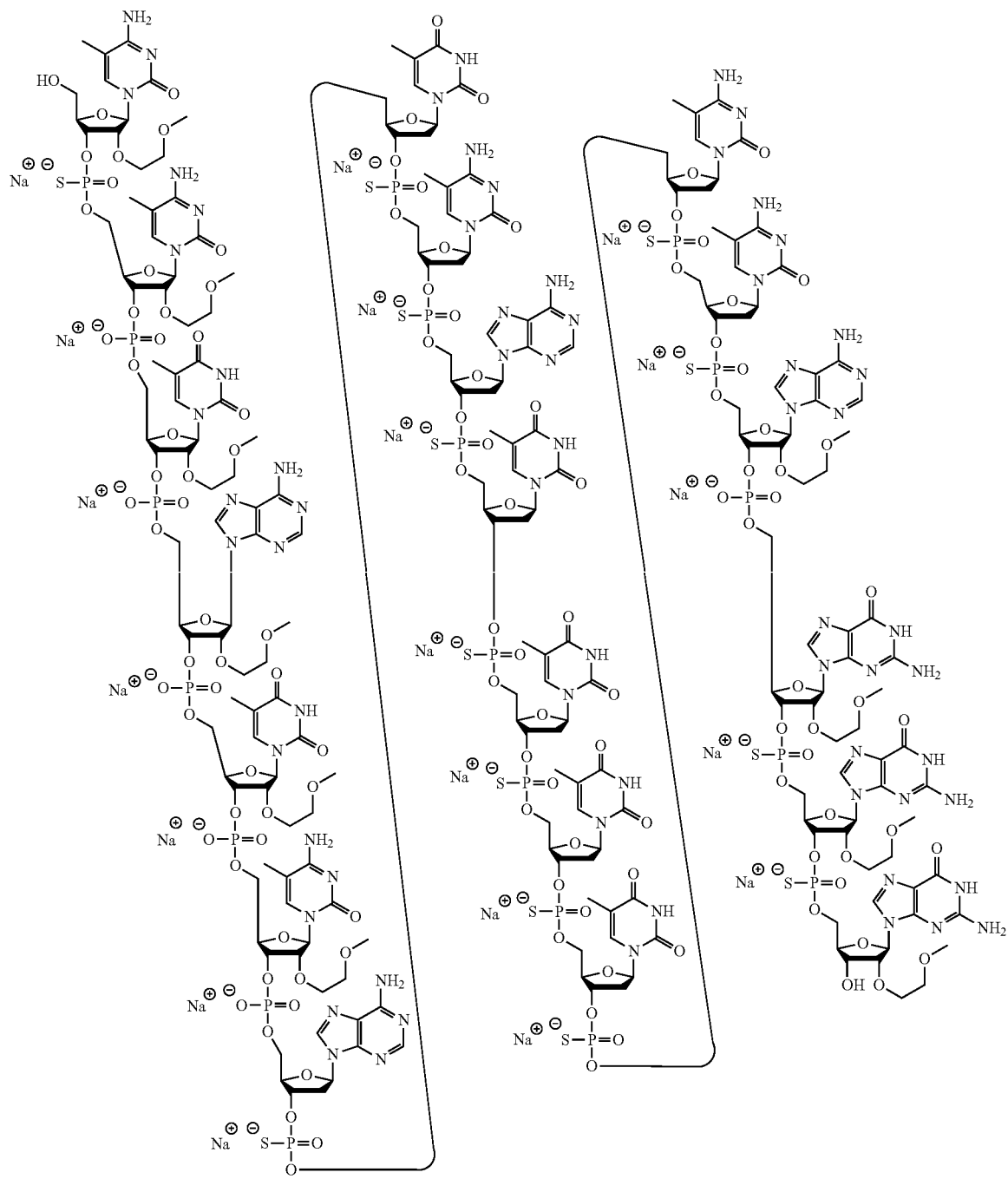

SEQ ID NO: 158

Structure 10. Sodium Salt of Compound No. 1008874

6. Compound No: 1008910

Compound No: 1008910 may be characterized as a 5-10-5 MOE gapmer, having a sequence of (from 5' to 3') TCTGTACTTTTCTCATGTGC (incorporated herein as SEQ ID NO: 2544), wherein each of nucleosides 1-5 and 16-20 (from 5' to 3') comprise a 2'-MOE modification and each of nucleosides 6-15 are 2'-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

Compound No: 1008910 may be characterized by the following chemical notation: Tes mCeo Teo Geo Tes Ads mCds Tds Tds Tds Tds mCds Tds mCds Ads Teo Geo Tes Ges mCe; wherein, A=an adenine nucleobase, mC=a 5-methyl cytosine nucleobase, G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.

Compound No: 1008910 may be represented by the following chemical structure:

In certain embodiments, the sodium salt of Compound No: 1008910 may be represented by the following chemical structure:

SEQ ID NO: 2544

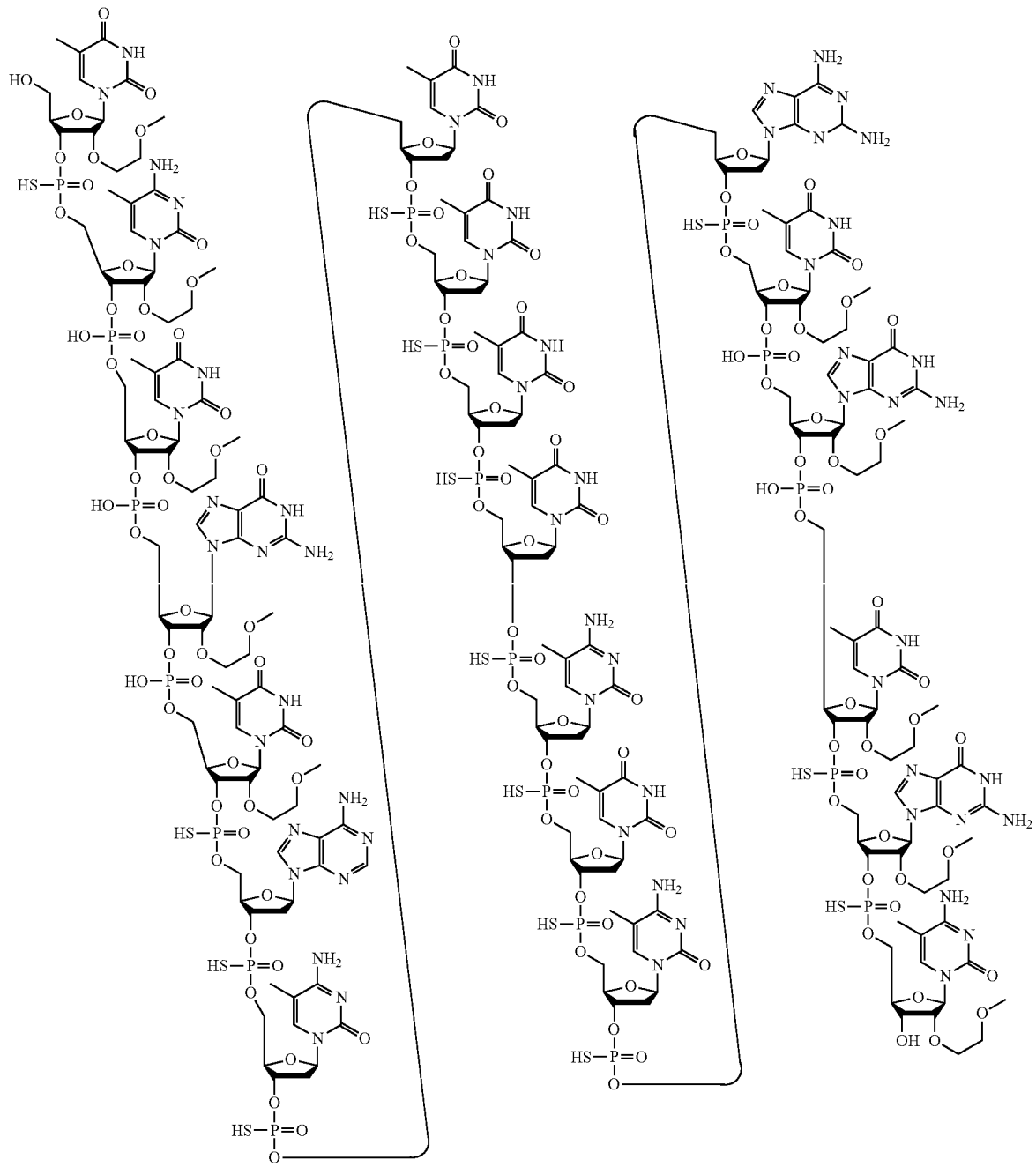

Structure 11. Compound No. 1008910

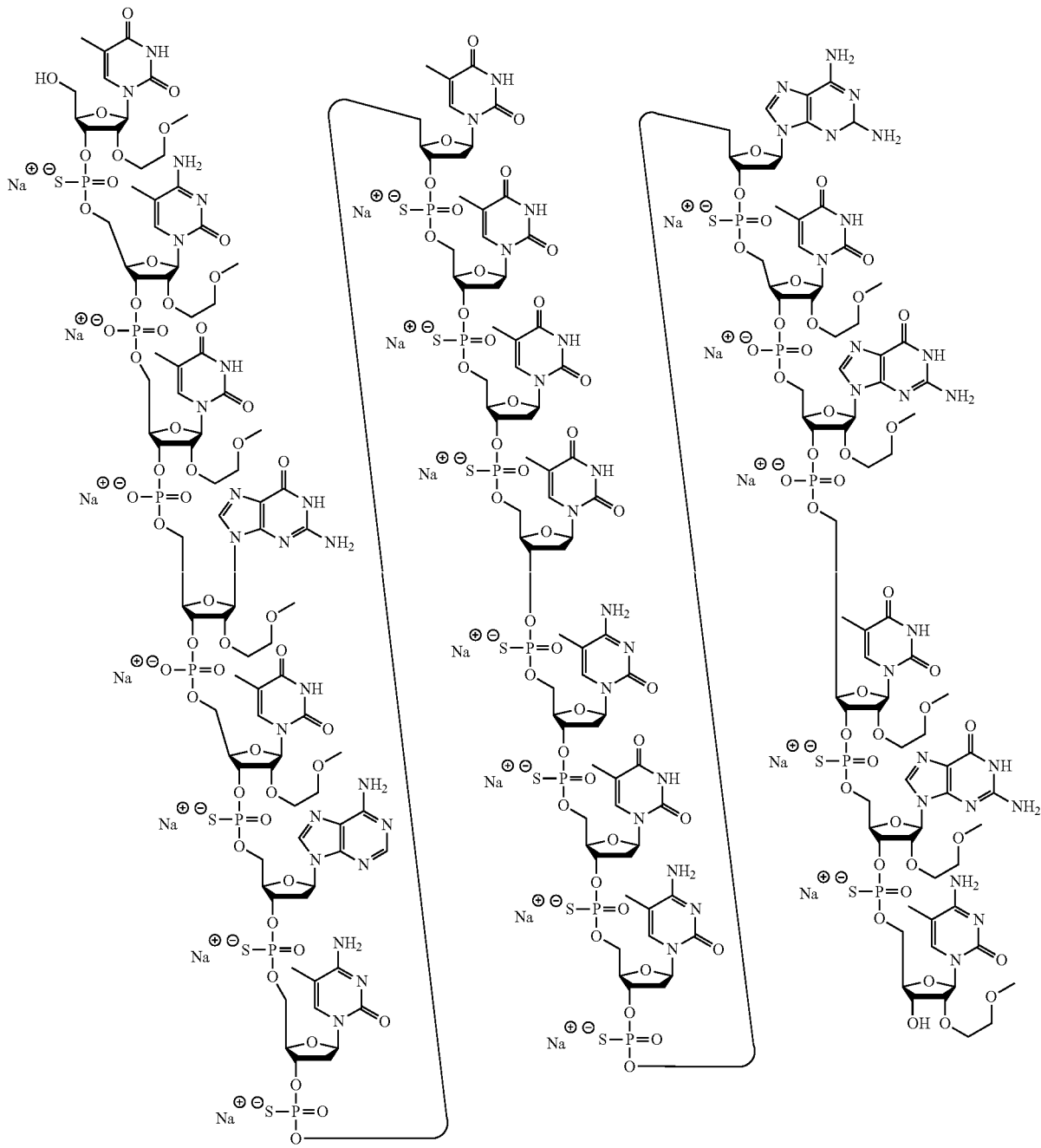

Structure 12. The Sodium Salt of Compound No. 1008910

VIII. Certain Comparator Compositions

In certain embodiments, Compound No. 564122, which was previously described in WO 2015/143246 and in Scoles et al., Nature, 2017, 544(7650):362-366 (both of which are incorporated herein by reference) is a comparator compound. Compound No. 564122 is a 5-10-5 MOE gapmer, having a sequence from (from 5' to 3') TGCATAGATTC-CATCAAAAG (incorporated herein as SEQ ID NO: 67), wherein each cytosine is a 5-methylcytosine, each internucleoside linkage is a phosphorothioate internucleoside linkage, and each of nucleosides 1-5 and 16-20 comprise a 2'-OCH$_2$CH$_2$OCH$_3$ group.

In certain embodiments, Compound No. 564127, which was previously described in WO 2015/143246 and in Scoles, 2017 is a comparator compound. Compound No. 564127 is a 5-10-5 MOE gapmer, having a sequence from (from 5' to 3') CTCTCCATTATTTCTTCACG (incorporated herein as SEQ ID NO: 33), wherein each cytosine is a 5-methylcytosine, each internucleoside linkage is a phosphorothioate internucleoside linkage, and each of nucleosides 1-5 and 16-20 comprise a 2'-OCH$_2$CH$_2$OCH$_3$ group.

In certain embodiments, Compound No. 564133, which was previously described in WO 2015/143246 and in Scoles, 2017 is a comparator compound. Compound No. 564133 is a 5-10-5 MOE gapmer, having a sequence from (from 5' to 3') GCTAACTGGTTTGCCCTTGC (incorporated herein as SEQ ID NO: 32), wherein each cytosine is a 5-methylcytosine, each internucleoside linkage is a phosphorothioate internucleoside linkage, and each of nucleosides 1-5 and 16-20 comprise a 2'-OCH$_2$CH$_2$OCH$_3$ group.

In certain embodiments, Compound No. 564143, which was previously described in WO 2015/143246 and in Scoles, 2017 is a comparator compound. Compound No. 564143 is a 5-10-5 MOE gapmer, having a sequence from (from 5' to 3') GGAGCTGGAGAACCATGAGC (incorporated herein as SEQ ID NO: 188), wherein each cytosine is a 5-methylcytosine, each internucleoside linkage is a phosphorothioate internucleoside linkage, and each of nucleosides 1-5 and 16-20 comprise a 2'-OCH$_2$CH$_2$OCH$_3$ group.

In certain embodiments, Compound No. 564150, which was previously described in WO 2015/143246 and in Scoles, 2017 is a comparator compound. Compound No. 564150 is a 5-10-5 MOE gapmer, having a sequence from (from 5' to 3') CTGGTACAGTTGCTGCTGCT (incorporated herein as SEQ ID NO: 330), wherein each cytosine is a 5-methylcytosine, each internucleoside linkage is a phosphorothioate internucleoside linkage, and each of nucleosides 1-5 and 16-20 comprise a 2'-OCH$_2$CH$_2$OCH$_3$ group.

In certain embodiments, Compound No. 564188, which was previously described in WO 2015/143246 and in Scoles, 2017 is a comparator compound. Compound No. 564188 is a 5-10-5 MOE gapmer, having a sequence from (from 5' to 3') CCCAAAGGGTTAATTAGGAT (incorporated herein as SEQ ID NO: 2901), wherein each cytosine is a 5-methylcytosine, each internucleoside linkage is a phosphorothioate internucleoside linkage, and each of nucleosides 1-5 and 16-20 comprise a 2'-OCH$_2$CH$_2$OCH$_3$ group.

In certain embodiments, Compound No. 564210, which was previously described in WO 2015/143246 and in Scoles, 2017 is a comparator compound. Compound No. 564210 is a 5-10-5 MOE gapmer, having a sequence from (from 5' to 3') CCCATACGCGGTGAATTCTG (incorporated herein as SEQ ID NO: 112), wherein each cytosine is a 5-methylcytosine, each internucleoside linkage is a phosphorothioate internucleoside linkage, and each of nucleosides 1-5 and 16-20 comprise a 2'-OCH$_2$CH$_2$OCH$_3$ group.

In certain embodiments, Compound No. 564216, which was previously described in WO 2015/143246 and in Scoles, 2017 is a comparator compound. Compound No. 564216 is a 5-10-5 MOE gapmer, having a sequence from (from 5' to 3') GTGGGATACAAATTCTAGGC (incorporated herein as SEQ ID NO: 190), wherein each cytosine is a 5-methylcytosine, each internucleoside linkage is a phosphorothioate internucleoside linkage, and each of nucleosides 1-5 and 16-20 comprise a 2'-OCH$_2$CH$_2$OCH$_3$ group.

In certain embodiments, compounds described herein are superior relative to compounds described in WO 2015/143246 and in Scoles, 2017 because they demonstrate one or more improved properties.

Compound 874218

For example, as provided in Example 13 (hereinbelow), Compound 874218 demonstrated a functional observational battery (FOB) score of 1.00 in wild-type mice whereas each of Comparator Compounds Nos: 564122, 564127, 564133, 564143, 564150, 564188, 564210, and 564216 demonstrated a FOB score of 7.00. Therefore, Compound 874218 is demonstrably more tolerable than each of Comparator Compounds Nos: 564122, 564127, 564133, 564143, 564150, 564188, 564210, and 564216 in this assay.

Compound 1008854

For example, as provided in Example 13 (hereinbelow), Compound 1008854 demonstrated a functional observational battery (FOB) score of 1.00 in wild-type mice whereas each of Comparator Compounds Nos: 564122, 564127, 564133, 564143, 564150, 564188, 564210, and 564216 demonstrated a FOB score of 7.00. Therefore, Compound 1008854 is demonstrably more tolerable than each of Comparator Compounds Nos: 564122, 564127, 564133, 564143, 564150, 564188, 564210, and 564216 in this assay.

Compound 1008862

For example, as provided in Example 13 (hereinbelow), Compound 1008862 demonstrated a functional observational battery (FOB) score of 2.50 in wild-type mice whereas each of Comparator Compounds Nos: 564122, 564127, 564133, 564143, 564150, 564188, 564210, and 564216 demonstrated a FOB score of 7.00. Therefore, Compound 1008862 is demonstrably more tolerable than each of Comparator Compounds Nos: 564122, 564127, 564133, 564143, 564150, 564188, 564210, and 564216 in this assay.

Compound 1008870

For example, as provided in Example 13 (hereinbelow), Compound 1008870 demonstrated a functional observational battery (FOB) score of 1.00 in wild-type mice whereas each of Comparator Compounds Nos: 564122, 564127, 564133, 564143, 564150, 564188, 564210, and 564216 demonstrated a FOB score of 7.00. Therefore, Compound 1008870 is demonstrably more tolerable than each of Comparator Compounds Nos: 564122, 564127, 564133, 564143, 564150, 564188, 564210, and 564216 in this assay.

Compound 1008874

For example, as provided in Example 13 (hereinbelow), Compound 1008874 demonstrated a functional observational battery (FOB) score of 1.25 in wild-type mice whereas each of Comparator Compounds Nos: 564122, 564127, 564133, 564143, 564150, 564188, 564210, and 564216 demonstrated a FOB score of 7.00. Therefore, Compound 1008874 is demonstrably more tolerable than each of Comparator Compounds Nos: 564122, 564127, 564133, 564143, 564150, 564188, 564210, and 564216 in this assay.

Compound 1008910

For example, as provided in Example 13 (hereinbelow), Compound 1008910 demonstrated a functional observational battery (FOB) score of 0.00 in wild-type mice whereas each of Comparator Compounds Nos: 564122, 564127, 564133, 564143, 564150, 564188, 564210, and 564216 demonstrated a FOB score of 7.00. Therefore, Compound 1008910 is demonstrably more tolerable than each of Comparator Compounds Nos: 564122, 564127, 564133, 564143, 564150, 564188, 564210, and 564216 in this assay.

IX. Certain Hotspot Regions

1. Nucleobases 2,455-2,483 of SEQ ID NO: 1

In certain embodiments, nucleobases 2,455-2,483 of SEQ ID NO: 1 comprise a hotspot region. In certain embodiments, modified oligonucleotides are complementary to nucleobases 2,455-2,483 of SEQ ID NO: 1. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': soooossssssssssssooss.

The nucleobase sequences of SEQ ID Nos: 286, 287, 1113, 1188, 1260, 1336, 1412, 2391, 2468, and 3002 are complementary to nucleobases 2,455-2,483 of SEQ ID NO: 1.

In certain embodiments, modified oligonucleotides complementary to nucleobases 2,455-2,483 of SEQ ID NO: 1 achieve at least 67% reduction of ATXN2 RNA in vitro in the standard cell assay.

2. Nucleobases 4,393-4,424 of SEQ ID NO: 1

In certain embodiments, nucleobases 4,393-4,424 of SEQ ID NO: 1 comprise a hotspot region. In certain embodiments, modified oligonucleotides are complementary to nucleobases 4,393-4,424 of SEQ ID NO: 1. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooooossssssssssooss.

The nucleobase sequences of SEQ ID Nos: 1945, 2020, 2316, 2392, 2469, 2546, 2623, 2697, 2926, 3003, 3080, and 3157 are complementary to nucleobases 4,393-4,424 of SEQ ID NO: 1.

In certain embodiments, modified oligonucleotides complementary to nucleobases 4,393-4,424 of SEQ ID NO: 1 achieve at least 64% reduction of ATXN2 RNA in vitro in the standard cell assay.

3. Nucleobases 4,413-4,437 of SEQ ID NO: 1

In certain embodiments, nucleobases 4,413-4,437 of SEQ ID NO: 1 comprise a hotspot region. In certain embodiments, modified oligonucleotides are complementary to nucleobases 4,413-4,437 of SEQ ID NO: 1. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooooossssssssssooss.

The nucleobase sequences of SEQ ID Nos: 2247, 2317, 2393, 2470, 2927, and 3004 are complementary to nucleobases 4,413-4,437 of SEQ ID NO: 1.

In certain embodiments, modified oligonucleotides complementary to nucleobases 4,413-4,437 of SEQ ID NO: 1 achieve at least 68% reduction of ATXN2 RNA in vitro in the standard cell assay.

4. Nucleobases 4,525-4,554 of SEQ ID NO: 2 In certain embodiments, nucleobases 4,525-4,554 of SEQ ID NO: 2 comprise a hotspot region. In certain embodiments, modified oligonucleotides are complementary to nucleobases 4,525-4,554 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooooossssssssssooss.

The nucleobase sequences of SEQ ID Nos: 1948, 2319, 2549, 2625, 2701, 2777, 2853, 2929, 3006, 3083, and 3160 are complementary to nucleobases 4,525-4,554 of SEQ ID NO: 2.

In certain embodiments, modified oligonucleotides complementary to nucleobases 4,525-4,554 of SEQ ID NO: 2 achieve at least 79% reduction of ATXN2 RNA in vitro in the standard cell assay.

5. Nucleobases 4,748-4,771 of SEQ ID NO: 2

In certain embodiments, nucleobases 4,748-4,771 of SEQ ID NO: 2 comprise a hotspot region. In certain embodiments, modified oligonucleotides are complementary to nucleobases 4,748-4,771 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': soooosssssssssooss.

The nucleobase sequences of SEQ ID Nos: 2175, 2626, 2702, 2778, and 3161 are complementary to nucleobases 4,748-4,771 of SEQ ID NO: 2.

In certain embodiments, modified oligonucleotides complementary to nucleobases 4,748-4,771 of SEQ ID NO: 2 achieve at least 70% reduction of ATXN2 RNA in vitro in the standard cell assay.

6. Nucleobases 9,927-9,954 of SEQ ID NO: 2

In certain embodiments, nucleobases 9,927-9,954 of SEQ ID NO: 2 comprise a hotspot region. In certain embodiments, modified oligonucleotides are complementary to nucleobases 9,927-9,954 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooosssssssssooss.

The nucleobase sequences of SEQ ID Nos: 2177, 2399, 2476, 2553, 2629, 2705, 3010, 3087, and 3164 are complementary to nucleobases 9,927-9,954 of SEQ ID NO: 2.

In certain embodiments, modified oligonucleotides complementary to nucleobases 9,927-9,954 of SEQ ID NO: 2 achieve at least 62% reduction of ATXN2 RNA in vitro in the standard cell assay. 7. Nucleobases 10,345-10,368 of SEQ ID NO: 2

In certain embodiments, nucleobases 10,345-10,368 of SEQ ID NO: 2 comprise a hotspot region. In certain embodiments, modified oligonucleotides are complementary to nucleobases 10,345-10,368 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooooosssssssssooss.

The nucleobase sequences of SEQ ID Nos: 2323, 2400, 2477, 2933, and 3011 are complementary to nucleobases 10,345-10,368 of SEQ ID NO: 2.

In certain embodiments, modified oligonucleotides complementary to nucleobases 10,345-10,368 of SEQ ID NO: 2 achieve at least 87% reduction of ATXN2 RNA in vitro in the standard cell assay.

8. Nucleobases 17,153-17,182 of SEQ ID NO: 2

In certain embodiments, nucleobases 17,153-17,182 of SEQ ID NO: 2 comprise a hotspot region. In certain embodiments, modified oligonucleotides are complementary to nucleobases 17,153-17,182 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': soooosssssssssssooss.

The nucleobase sequences of SEQ ID Nos: 973, 2479, 2556, 2632, 2708, 2784, 2860, 2936, 3013, 3090, and 3167 are complementary to nucleobases 17,153-17,182 of SEQ ID NO: 2.

In certain embodiments, modified oligonucleotides complementary to nucleobases 17,153-17,182 of SEQ ID NO: 2 achieve at least 68% reduction of ATXN2 RNA in vitro in the standard cell assay. 9. Nucleobases 18,680-18,702 of SEQ ID NO: 2

In certain embodiments, nucleobases 18,680-18,702 of SEQ ID NO: 2 comprise a hotspot region. In certain embodiments, modified oligonucleotides are complementary to nucleobases 18,680-18,702 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': soooosssssssssssooss.

The nucleobase sequences of SEQ ID Nos: 2256, 2557, 3014, and 3091 are complementary to nucleobases 18,680-18,702 of SEQ ID NO: 2.

In certain embodiments, modified oligonucleotides complementary to nucleobases 18,680-18,702 of SEQ ID NO: 2 achieve at least 65% reduction of ATXN2 RNA in vitro in the standard cell assay.

10. Nucleobases 23,251-23,276 of SEQ ID NO: 2

In certain embodiments, nucleobases 23,251-23,276 of SEQ ID NO: 2 comprise a hotspot region. In certain embodiments, modified oligonucleotides are complementary to nucleobases 23,251-23,276 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': soooosssssssssssooss.

The nucleobase sequences of SEQ ID Nos: 1805, 2635, 2711, 2787, 2863, 2939, and 3170 are complementary to nucleobases 23,251-23,276 of SEQ ID NO: 2.

In certain embodiments, modified oligonucleotides complementary to nucleobases 23,251-23,276 of SEQ ID NO: 2 achieve at least 64% reduction of ATXN2 RNA in vitro in the standard cell assay.

11. Nucleobases 28,081-28,105 of SEQ ID NO: 2

In certain embodiments, nucleobases 28,081-28,105 of SEQ ID NO: 2 comprise a hotspot region. In certain embodiments, modified oligonucleotides are complementary to nucleobases 28,081-28,105 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooooosssssssssssooss.

The nucleobase sequences of SEQ ID Nos: 2259, 2331, 2713, 2789, 2865, and 2941 are complementary to nucleobases 28,081-28,105 of SEQ ID NO: 2.

In certain embodiments, modified oligonucleotides complementary to nucleobases 28,081-28,105 of SEQ ID NO: 2 achieve at least 62% reduction of ATXN2 RNA in vitro in the standard cell assay.

12. Nucleobases 28,491-28,526 of SEQ ID NO: 2

In certain embodiments, nucleobases 28,491-28,526 of SEQ ID NO: 2 comprise a hotspot region. In certain embodiments, modified oligonucleotides are complementary to nucleobases 28,491-28,526 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooooosssssssssssooss.

The nucleobase sequences of SEQ ID Nos: 669, 746, 2562, 2638, 2714, 2790, 2866, 3019, 3096, and 3173 are complementary to nucleobases 28,491-28,526 of SEQ ID NO: 2.

In certain embodiments, modified oligonucleotides complementary to nucleobases 28,491-28,526 of SEQ ID NO: 2 achieve at least 67% reduction of ATXN2 RNA in vitro in the standard cell assay.

13. Nucleobases 28,885-28,912 of SEQ ID NO: 2

In certain embodiments, nucleobases 28,885-28,912 of SEQ ID NO: 2 comprise a hotspot region. In certain embodiments, modified oligonucleotides are complementary to nucleobases 28,885-28,912 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': soooosssssssssssooss.

The nucleobase sequences of SEQ ID Nos: 977, 2486, 2563, 2639, 2715, 2791, 3020, 3097, and 3174 are complementary to nucleobases 28,885-28,912 of SEQ ID NO: 2.

In certain embodiments, modified oligonucleotides complementary to nucleobases 28,885-28,912 of SEQ ID NO: 2 achieve at least 75% reduction of ATXN2 RNA in vitro in the standard cell assay.

14. Nucleobases 32,328-32,352 of SEQ ID NO: 2

In certain embodiments, nucleobases 32,328-32,352 of SEQ ID NO: 2 comprise a hotspot region. In certain embodiments, modified oligonucleotides are complementary to nucleobases 32,328-32,352 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': soooosssssssssooss.

The nucleobase sequences of SEQ ID Nos: 2109, 2334, 2411, 2488, 2565, and 3022 are complementary to nucleobases 32,328-32,352 of SEQ ID NO: 2.

In certain embodiments, modified oligonucleotides complementary to nucleobases 32,328-32,352 of SEQ ID NO: 2 achieve at least 66% reduction of ATXN2 RNA in vitro in the standard cell assay.

15. Nucleobases 32,796-32,824 of SEQ ID NO: 2

In certain embodiments, nucleobases 32,796-32,824 of SEQ ID NO: 2 comprise a hotspot region. In certain embodiments, modified oligonucleotides are complementary to nucleobases 32,796-32,824 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': soooosssssssssooss.

The nucleobase sequences of SEQ ID Nos: 902, 2335, 2412, 2489, 2566, 2869, 2945, 3023, 3100, and 3177 are complementary to nucleobases 32,796-32,824 of SEQ ID NO: 2.

In certain embodiments, modified oligonucleotides complementary to nucleobases 32,796-32,824 of SEQ ID NO: 2 achieve at least 72% reduction of ATXN2 RNA in vitro in the standard cell assay.

16. Nucleobases 32,809-32,838 of SEQ ID NO: 2

In certain embodiments, nucleobases 32,809-32,838 of SEQ ID NO: 2 comprise a hotspot region. In certain embodiments, modified oligonucleotides are complementary to nucleobases 32,809-32,838 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': soooosssssssssooss.

The nucleobase sequences of SEQ ID Nos: 979, 2336, 2413, 2490, 2567, 2643, 2870, 2946, 3024, 3101, and 3178 are complementary to nucleobases 32,809-32,838 of SEQ ID NO: 2.

In certain embodiments, modified oligonucleotides complementary to nucleobases 32,809-32,838 of SEQ ID NO: 2 achieve at least 60% reduction of ATXN2 RNA in vitro in the standard cell assay.

17. Nucleobases 36,308-36,334 of SEQ ID NO: 2

In certain embodiments, nucleobases 36,308-36,334 of SEQ ID NO: 2 comprise a hotspot region. In certain embodiments, modified oligonucleotides are complementary to nucleobases 36,308-36,334 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': soooosssssssssooss.

The nucleobase sequences of SEQ ID Nos: 1280, 2338, 2415, 2644, 2720, 2796, 2872, and 2948 are complementary to nucleobases 36,308-36,334 of SEQ ID NO: 2.

In certain embodiments, modified oligonucleotides complementary to nucleobases 36,308-36,334 of SEQ ID NO: 2 achieve at least 69% reduction of ATXN2 RNA in vitro in the standard cell assay.

18. Nucleobases 36,845-36,872 of SEQ ID NO: 2

In certain embodiments, nucleobases 36,845-36,872 of SEQ ID NO: 2 comprise a hotspot region. In certain embodiments, modified oligonucleotides are complementary to nucleobases 36,845-36,872 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': soooosssssssssooss.

The nucleobase sequences of SEQ ID Nos: 2035, 2339, 2645, 2721, 2797, 2873, 2949, 3103, and 3180 are complementary to nucleobases 36,845-36,872 of SEQ ID NO: 2.

In certain embodiments, modified oligonucleotides complementary to nucleobases 36,845-36,872 of SEQ ID NO: 2 achieve at least 63% reduction of ATXN2 RNA in vitro in the standard cell assay.

19. Nucleobases 49,147-49,173 of SEQ ID NO: 2

In certain embodiments, nucleobases 49,147-49,173 of SEQ ID NO: 2 comprise a hotspot region. In certain embodiments, modified oligonucleotides are complementary to nucleobases 49,147-49,173 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': soooosssssssssooss.

The nucleobase sequences of SEQ ID Nos: 1439, 2575, 2651, 2727, 2803, 3032, 3109, and 3186 are complementary to nucleobases 49,147-49,173 of SEQ ID NO: 2.

In certain embodiments, modified oligonucleotides complementary to nucleobases 49,147-49,173 of SEQ ID NO: 2 achieve at least 69% reduction of ATXN2 RNA in vitro in the standard cell assay.

20. Nucleobases 57,469-57,494 of SEQ ID NO: 2

In certain embodiments, nucleobases 57,469-57,494 of SEQ ID NO: 2 comprise a hotspot region. In certain embodiments, modified oligonucleotides are complementary to nucleobases 57,469-57,494 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': soooosssssssssooss.

The nucleobase sequences of SEQ ID Nos: 2045, 2121, 2426, 2503, 2580, 3037, and 3114 are complementary to nucleobases 57,469-57,494 of SEQ ID NO: 2.

In certain embodiments, modified oligonucleotides complementary to nucleobases 57,469-57,494 of SEQ ID NO: 2 achieve at least 49% reduction of ATXN2 RNA in vitro in the standard cell assay.

21. Nucleobases 82,848-82,874 of SEQ ID NO: 2

In certain embodiments, nucleobases 82,848-82,874 of SEQ ID NO: 2 comprise a hotspot region. In certain embodiments, modified oligonucleotides are complementary to nucleobases 82,848-82,874 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': soooosssssssssooss.

The nucleobase sequences of SEQ ID Nos: 1982, 2359, 2436, 2513, 2590, 2969, 3047, and 3124 are complementary to nucleobases 82,848-82,874 of SEQ ID NO: 2.

In certain embodiments, modified oligonucleotides complementary to nucleobases 82,848-82,874 of SEQ ID NO: 2 achieve at least 57% reduction of ATXN2 RNA in vitro in the standard cell assay.

22. Nucleobases 83,784-83,813 of SEQ ID NO: 2

In certain embodiments, nucleobases 83,784-83,813 of SEQ ID NO: 2 comprise a hotspot region. In certain embodiments, modified oligonucleotides are complementary to nucleobases 83,784-83,813 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': soooosssssssssooss.

The nucleobase sequences of SEQ ID Nos: 849, 2361, 2438, 2515, 2592, 2668, 2744, 2971, 3049, 3126, and 3203 are complementary to nucleobases 83,784-83,813 of SEQ ID NO: 2.

In certain embodiments, modified oligonucleotides complementary to nucleobases 83,784-83,813 of SEQ ID NO: 2 achieve at least 76% reduction of ATXN2 RNA in vitro in the standard cell assay.

23. Nucleobases 84,743-84,782 of SEQ ID NO: 2

In certain embodiments, nucleobases 84,743-84,782 of SEQ ID NO: 2 comprise a hotspot region. In certain embodiments, modified oligonucleotides are complementary to nucleobases 84,743-84,782 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': soooosssssssssooss.

The nucleobase sequences of SEQ ID Nos: 2210, 2441, 2518, 2595, 2671, 2747, 2823, 2899, 2975, 3052, 3129, and 3206 are complementary to nucleobases 84,743-84,782 of SEQ ID NO: 2.

In certain embodiments, modified oligonucleotides complementary to nucleobases 84,743-84,782 of SEQ ID NO: 2 achieve at least 58% reduction of ATXN2 RNA in vitro in the standard cell assay.

24. Nucleobases 84,813-84,839 of SEQ ID NO: 2

In certain embodiments, nucleobases 84,813-84,839 of SEQ ID NO: 2 comprise a hotspot region. In certain embodiments, modified oligonucleotides are complementary to nucleobases 84,813-84,839 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': soooosssssssssooss.

The nucleobase sequences of SEQ ID Nos: 542, 2286, 2672, 2748, 2824, 2900, 3130, and 3207 are complementary to nucleobases 84,813-84,839 of SEQ ID NO: 2.

In certain embodiments, modified oligonucleotides complementary to nucleobases 84,813-84,839 of SEQ ID NO: 2 achieve at least 69% reduction of ATXN2 RNA in vitro in the standard cell assay.

25. Nucleobases 85,051-85,076 of SEQ ID NO: 2

In certain embodiments, nucleobases 85,051-85,076 of SEQ ID NO: 2 comprise a hotspot region. In certain embodiments, modified oligonucleotides are complementary to nucleobases 85,051-85,076 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': soooosssssssssooss.

The nucleobase sequences of SEQ ID Nos: 773, 850, 2673, 2749, 2825, 3131, and 3208 are complementary to nucleobases 85,051-85,076 of SEQ ID NO: 2.

In certain embodiments, modified oligonucleotides complementary to nucleobases 85,051-85,076 of SEQ ID NO: 2 achieve at least 57% reduction of ATXN2 RNA in vitro in the standard cell assay.

26. Nucleobases 97,618-97,643 of SEQ ID NO: 2

In certain embodiments, nucleobases 97,618-97,643 of SEQ ID NO: 2 comprise a hotspot region. In certain embodiments, modified oligonucleotides are complementary to nucleobases 97,618-97,643 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': soooosssssssssooss.

The nucleobase sequences of SEQ ID Nos: 1839, 2370, 2447, 2524, 2904, 2980, and 3058 are complementary to nucleobases 97,618-97,643 of SEQ ID NO: 2.

In certain embodiments, modified oligonucleotides complementary to nucleobases 97,618-97,643 of SEQ ID NO: 2 achieve at least 72% reduction of ATXN2 RNA in vitro in the standard cell assay.

27. Nucleobases 119,023-119,048 of SEQ ID NO: 2

In certain embodiments, nucleobases 119,023-119,048 of SEQ ID NO: 2 comprise a hotspot region. In certain embodiments, modified oligonucleotides are complementary to nucleobases 119,023-119,048 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': soooosssssssssooss.

The nucleobase sequences of SEQ ID Nos: 2072, 2606, 2682, 2758, 2834, 3140, and 3217 are complementary to nucleobases 119,023-119,048 of SEQ ID NO: 2.

In certain embodiments, modified oligonucleotides complementary to nucleobases 119,023-119,048 of SEQ ID NO: 2 achieve at least 69% reduction of ATXN2 RNA in vitro in the standard cell assay.

28. Nucleobases 132,161-132,195 of SEQ ID NO: 2

In certain embodiments, nucleobases 132,161-132,195 of SEQ ID NO: 2 comprise a hotspot region. In certain embodiments, modified oligonucleotides are complementary to nucleobases 132,161-132,195 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': soooosssssssssooss.

The nucleobase sequences of SEQ ID Nos: 1927, 2002, 2381, 2458, 2763, 2839, 2915, and 2991 are complementary to nucleobases 132,161-132,195 of SEQ ID NO: 2.

In certain embodiments, modified oligonucleotides complementary to nucleobases 132,161-132,195 of SEQ ID NO: 2 achieve at least 78% reduction of ATXN2 RNA in vitro in the standard cell assay.

29. Nucleobases 139,271-139,303 of SEQ ID NO: 2

In certain embodiments, nucleobases 139,271-139,303 of SEQ ID NO: 2 comprise a hotspot region. In certain embodiments, modified oligonucleotides are complementary to nucleobases 139,271-139,303 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': soooosssssssssooss.

The nucleobase sequences of SEQ ID Nos: 795, 872, 2540, 2617, 3074, and 3151 are complementary to nucleobases 139,271-139,303 of SEQ ID NO: 2.

In certain embodiments, modified oligonucleotides complementary to nucleobases 139,271-139,303 of SEQ ID NO: 2 achieve at least 61% reduction of ATXN2 RNA in vitro in the standard cell assay.

30. Nucleobases 1,075-1,146 of SEQ ID NO: 1

In certain embodiments, nucleobases 1,075-1,146 of SEQ ID NO: 1 comprise a hotspot region. In certain embodiments, modified oligonucleotides are complementary to nucleobases 1,075-1,146 of SEQ ID NO: 1. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the gapmers are 6-10-4 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': soooosssssssssooss. In certain embodiments, the phosphodiester ("o") and phosphorothioate ("s") internucleoside linkages are arranged in order from 5' to 3': In certain embodiments, the phosphodiester ("o") and phosphorothioate ("s") internucleoside linkages are arranged in order from 5' to 3': soooosssssssssooss.

The nucleobase sequences of SEQ ID Nos: 33, 1485, 1561, 1637, 1714, 1788, 1861, 1936, 2013, 2088, 2164, 2467, 2544, 3001, 3232, 3233, 3234, 3235, 3237, 3238, 3239, 3298, 3299, 3300, and 3301 are complementary to nucleobases 1,075-1,146 of SEQ ID NO: 1.

In certain embodiments, modified oligonucleotides complementary to nucleobases 1,075-1,146 of SEQ ID NO: 1 achieve at least 49% reduction of ATXN2 mRNA in vitro in the standard cell assay.

Nonlimiting Disclosure and Incorporation by Reference

Each of the literature and patent publications listed herein is incorporated by reference in its entirety.

While certain compounds, compositions and methods described herein have been described with specificity in accordance with certain embodiments, the following examples serve only to illustrate the compounds described herein and are not intended to limit the same. Each of the references, GenBank accession numbers, and the like recited in the present application is incorporated herein by reference in its entirety.

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar (2'-OH in place of one 2'-H of DNA) or as an RNA having a modified base (thymine (methylated uracil) in place of a uracil of RNA). Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of further example and without limitation, an oligomeric compound having the nucleobase sequence "ATCGATCG" encompasses any oligomeric compounds having such nucleobase sequence, whether modified or unmodified, including, but not limited to, such compounds comprising RNA bases, such as those having sequence "AUCGAUCG" and those having some DNA bases and some RNA bases such as "AUCGATCG" and oligomeric compounds having other modified nucleobases, such as "AT$^m$CGAUCG," wherein mC indicates a cytosine base comprising a methyl group at the 5-position.

Certain compounds described herein (e.g., modified oligonucleotides) have one or more asymmetric center and thus give rise to enantiomers, diastereomers, and other stereoisomeric configurations that may be defined, in terms of absolute stereochemistry, as (R) or (S), as α or β such as for sugar anomers, or as (D) or (L), such as for amino acids, etc. Compounds provided herein that are drawn or described as having certain stereoisomeric configurations include only the indicated compounds. Compounds provided herein that are drawn or described with undefined stereochemistry include all such possible isomers, including their stereorandom and optically pure forms, unless specified otherwise. Likewise, tautomeric forms of the compounds herein are also included unless otherwise indicated. Unless otherwise indicated, compounds described herein are intended to include corresponding salt forms.

The compounds described herein include variations in which one or more atoms are replaced with a non-radioactive isotope or radioactive isotope of the indicated element. For example, compounds herein that comprise hydrogen atoms encompass all possible deuterium substitutions for each of the $^1$H hydrogen atoms. Isotopic substitutions encompassed by the compounds herein include but are not limited to: $^2$H or $^3$H in place of $^1$H, $^{13}$C or $^{14}$C in place of $^{12}$C, $^{15}$N in place of $^{14}$N, $^{17}$O or $^{18}$O in place of $^{16}$O, and $^{33}$S, $^{34}$S, $^{35}$S, or $^{36}$S in place of $^{32}$S. In certain embodiments, non-radioactive isotopic substitutions may impart new properties on the oligomeric compound that are beneficial for use as a therapeutic or research tool. In certain embodiments, radioactive isotopic substitutions may make the compound suitable for research or diagnostic purposes such as imaging.

EXAMPLES

The following examples illustrate certain embodiments of the present disclosure and are not limiting. Moreover, where specific embodiments are provided, the inventors have contemplated generic application of those specific embodiments. For example, disclosure of an oligonucleotide having a particular motif provides reasonable support for additional oligonucleotides having the same or similar motif. And, for example, where a particular high-affinity modification appears at a particular position, other high-affinity modifications at the same position are considered suitable, unless otherwise indicated.

Example 1: Effect of 5-10-5 MOE Gapmers with Mixed Internucleoside Linkages on Human ATXN2 RNA In Vitro, Single Dose Modified oligonucleotides complementary to a human ATXN2 nucleic acid were designed and tested for their effect on ATXN2 RNA in SCA2-04 cells. SCA2-04 is a patient fibroblast cell line with 34 CAG repeats. The modified oligonucleotides were tested in a series of experiments that had similar culture conditions.

Cultured SCA2-04 cells at a density of 20,000 cells per well were transfected using electroporation with 2,000 or 7,000 nM concentration of modified oligonucleotide, as indicated in the tables below, or no modified oligonucleotide for untreated controls. After approximately 24 hours, RNA was isolated from the cells and ATXN2 RNA levels were measured by quantitative real-time PCR Human primer probe set hAtaxin_LTS01321 (forward sequence ATATGGACTCCAGTTATGCAAAAAGA, designated herein as SEQ ID NO: 10; reverse sequence TCGCCATTCACTTTAGCACTGA, designated herein as SEQ ID NO: 11; probe sequence ATGCTTTTACTGACTCTGC, designated herein as SEQ ID: 12) was used to measure RNA levels. ATXN2 RNA levels were adjusted according to total RNA content, as measured by RIBOGREEN®. Results are presented in the tables below as percent ATXN2 RNA levels relative to untreated control cells.

The modified oligonucleotides marked with an asterisk (*) target the amplicon region of the primer probe set. Additional assays may be used to measure the potency and efficacy of oligonucleotides targeting the amplicon region.

The modified oligonucleotides in the tables below are 5-10-5 MOE gapmers. The gapmers are 20 nucleobases in length, wherein the central gap segment comprises ten 2'-deoxynucleosides and is flanked by wing segments on both the 5' end and on the 3' end comprising five 2'-MOE nucleosides. The sugar motif for the gapmers is (from 5' to 3'): eeeeedddddddddeeeee; wherein 'd' represents a 2'-deoxyribose sugar and 'e' represents a 2'-MOE modified sugar. The internucleoside linkages are mixed phosphodiester and phosphorothioate internucleoside linkages. The internucleoside linkage motif for the gapmers is (from 5' to 3'): sooooossssssssssooss; wherein 'o' represents a phosphodiester internucleoside linkage and 's' represents a phosphorothioate internucleoside linkage. Each cytosine residue is a 5-methyl cytosine. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in the Tables below is complementary to human ATXN2 nucleic acid sequences SEQ ID NO: 1 or SEQ ID NO: 2, as indicated. 'N/A' indicates that the modified oligonucleotide is not complementary to that particular nucleic acid with 100% complementarity. As shown below, modified oligonucleotides complementary to the nucleobase sequence of human ATXN2 reduced the amount of human ATXN2 RNA.

TABLE 1

Percent control of human ATXN2 RNA with 5-10-5 MOE gapmers with mixed internucleoside linkages at 7,000 nM concentration

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % Control | SEQ ID NO |
|---|---|---|---|---|---|---|---|
| 708134 | 929 | 948 | N/A | N/A | GATTCCATCAAAAGAAATCG | 16 | 30 |

TABLE 1-continued

Percent control of human ATXN2 RNA with 5-10-5 MOE gapmers with mixed internucleoside linkages at 7,000 nM concentration

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % Control | SEQ ID NO |
|---|---|---|---|---|---|---|---|
| 708155 | 1094 | 1113 | 49268 | 49287 | CGAACTGGATTCTGTACTTT | 14 | 31 |
| 708199 | 1477 | 1496 | 81637 | 81656 | GCTAACTGGTTTGCCCTTGC | 10 | 32 |
| 755233 | 1123 | 1142 | 49297 | 49316 | CTCTCCATTATTTCTTCACG | 7 | 33 |
| 756933 | 717 | 736 | 2707 | 2726 | CGGGCGGCGGCTGCTGCTGC | 20 | 34 |
| 756934 | 723 | 742 | 2713 | 2732 | CAGCCGCGGGCGGCGGCTGC | 89 | 35 |
| 756935 | 729 | 748 | 2719 | 2738 | CATTGGCAGCCGCGGGCGGC | 33 | 36 |
| 756936 | 735 | 754 | 2725 | 2744 | TGCGGACATTGGCAGCCGCG | 51 | 37 |
| 756937 | 741 | 760 | 2731 | 2750 | CGGGCTTGCGGACATTGGCA | 15 | 38 |
| 756938 | 747 | 766 | 2737 | 2756 | TGCCGCCGGGCTTGCGGACA | 27 | 39 |
| 756939 | 759 | 778 | 2749 | 2768 | CTAGAAGGCCGCTGCCGCCG | 50 | 40 |
| 756940 | 778 | 797 | 2768 | 2787 | GGCGCGGCGGCGGGCGACGC | 13 | 41 |
| 756941 | 784 | 803 | 2774 | 2793 | GGCGAAGGCGCGGCGGCGGG | 49 | 42 |
| 756942 | 790 | 809 | 2780 | 2799 | GAGGACGGCGAAGGCGCGGC | 16 | 43 |
| 756943 | 796 | 815 | 2786 | 2805 | GAGGACGAGGACGGCGAAGG | 25 | 44 |
| 756944 | 802 | 821 | 2792 | 2811 | GAGACCGAGGACGAGGACGG | 34 | 45 |
| 756945 | 808 | 827 | 2798 | 2817 | GACGAGGAGACCGAGGACGA | 19 | 46 |
| 756946 | 814 | 833 | 2804 | 2823 | GCCGAGGACGAGGAGACCGA | 13 | 47 |
| 756947 | 820 | 839 | 2810 | 2829 | GCCGTGGCCGAGGACGAGGA | 23 | 48 |
| 756948 | 826 | 845 | 2816 | 2835 | GAGGGAGCCGTGGCCGAGGA | 36 | 49 |
| 756949 | 832 | 851 | 2822 | 2841 | ACCGAGGAGGGAGCCGTGGC | 47 | 50 |
| 756950 | 838 | 857 | 2828 | 2847 | GCGACCACCGAGGAGGGAGC | 51 | 51 |
| 756951 | 844 | 863 | 2834 | 2853 | GTCGCCGCGACCACCGAGGA | 20 | 52 |
| 756952 | 850 | 869 | 2840 | 2859 | CCGGAGGTCGCCGCGACCAC | 25 | 53 |
| 756953 | 856 | 875 | 2846 | 2865 | CCGCCGCCGGAGGTCGCCGC | 15 | 54 |
| 756954 | 862 | 881 | 2852 | 2871 | GGCCTCCCGCCGCCGGAGGT | 61 | 55 |
| 756955 | 868 | 887 | 2858 | 2877 | AGGCCGGGCCTCCCGCCGCC | 33 | 56 |
| 756956 | 874 | 893 | 2864 | 2883 | CTGCCCAGGCCGGGCCTCCC | 34 | 57 |
| 756957 | 880 | 899 | N/A | N/A | CGACCTCTGCCCAGGCCGGG | 31 | 58 |
| 756958 | 886 | 905 | N/A | N/A | CTGTTTCGACCTCTGCCCAG | 28 | 59 |
| 756959 | 892 | 911 | 45746 | 45765 | TTGTTACTGTTTCGACCTCT | 6 | 60 |
| 756960 | 898 | 917 | 45752 | 45771 | AGTCCTTTGTTACTGTTTCG | 9 | 61 |
| 756961 | 904 | 923 | 45758 | 45777 | TGAGGCAGTCCTTTGTTACT | 14 | 62 |
| 756962 | 910 | 929 | 45764 | 45783 | GTAGACTGAGGCAGTCCTTT | 17 | 63 |
| 756963 | 930 | 949 | 47449 | 47468 | AGATTCCATCAAAAGAAATC | 16 | 64 |
| 756964 | 932 | 951 | 47451 | 47470 | ATAGATTCCATCAAAAGAAA | 19 | 65 |
| 756965 | 934 | 953 | 47453 | 47472 | GCATAGATTCCATCAAAAGA | 22 | 66 |

TABLE 1-continued

Percent control of human ATXN2 RNA with 5-10-5 MOE gapmers
with mixed internucleoside linkages at 7,000 nM concentration

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % Control | SEQ ID NO |
| --- | --- | --- | --- | --- | --- | --- | --- |
| 756966 | 935 | 954 | 47454 | 47473 | TGCATAGATTCCATCAAAAG | 18 | 67 |
| 756967 | 936 | 955 | 47455 | 47474 | TTGCATAGATTCCATCAAAA | 21 | 68 |
| 756968 | 938 | 957 | 47457 | 47476 | ATTTGCATAGATTCCATCAA | 23 | 69 |
| 756969 | 940 | 959 | 47459 | 47478 | ATATTTGCATAGATTCCATC | 13 | 70 |
| 756970 | 941 | 960 | 47460 | 47479 | CATATTTGCATAGATTCCAT | 13 | 71 |
| 756971 | 947 | 966 | 47466 | 47485 | CATCCTCATATTTGCATAGA | 31 | 72 |
| 756972 | 953 | 972 | 47472 | 47491 | ATGAACCATCCTCATATTTG | 15 | 73 |
| 756973 | 959 | 978 | 47478 | 47497 | AAGTATATGAACCATCCTCA | 17 | 74 |
| 756974 | 965 | 984 | 47484 | 47503 | TGATGTAAGTATATGAACCA | 33 | 75 |
| 756975 | 971 | 990 | 47490 | 47509 | AACAACTGATGTAAGTATAT | 16 | 76 |
| 756976 | 979 | 998 | N/A | N/A | TTGGAGCCAACAACTGATGT | 28 | 77 |
| 756977 | 986 | 1005 | N/A | N/A | TTCACATTTGGAGCCAACAA | 17 | 78 |
| 756978 | 992 | 1011 | 48691 | 48710 | TTGTACTTCACATTTGGAGC | 8 | 79 |
| 756979 | 998 | 1017 | 48697 | 48716 | TTTCACTTGTACTTCACATT | 20 | 80 |
| 756980 | 1004 | 1023 | 48703 | 48722 | TCCATTTTTCACTTGTACTT | 9 | 81 |
| 756981 | 1010 | 1029 | 48709 | 48728 | TATACCTCCATTTTTCACTT | 11 | 82 |
| 756982 | 1016 | 1035 | 48715 | 48734 | TTCATATATACCTCCATTTT | 33 | 83 |
| 756983 | 1022 | 1041 | 48721 | 48740 | AACTCCTTCATATATACCTC | 11 | 84 |
| 756984 | 1028 | 1047 | 48727 | 48746 | TTTAAAAACTCCTTCATATA | 39 | 85 |
| 756985 | 1034 | 1053 | 48733 | 48752 | GTAAGTTTTAAAAACTCCTT | 8 | 86 |
| 756986 | 1040 | 1059 | 48739 | 48758 | CGGACTGTAAGTTTTAAAAA | 12 | 87 |
| 756987 | 1046 | 1065 | N/A | N/A | ACACTTCGGACTGTAAGTTT | 14 | 88 |
| 756988 | 1052 | 1071 | N/A | N/A | CAAATCACACTTCGGACTGT | 18 | 89 |
| 756989 | 1058 | 1077 | N/A | N/A | AAGTACCAAATCACACTTCG | 9 | 90 |
| 756990 | 1064 | 1083 | 49238 | 49257 | GGCATCAAGTACCAAATCAC | 20 | 91 |
| 756991 | 1070 | 1089 | 49244 | 49263 | ATGTGCGGCATCAAGTACCA | 9 | 92 |
| 756992 | 1076 | 1095 | 49250 | 49269 | TTTCTCATGTGCGGCATCAA | 19 | 93 |
| 756993 | 1082 | 1101 | 49256 | 49275 | TGTACTTTTCTCATGTGCGG | 5 | 94 |
| 756994 | 1088 | 1107 | 49262 | 49281 | GGATTCTGTACTTTTCTCAT | 37 | 95 |
| 756995 | 1100 | 1119 | 49274 | 49293 | CGGCCCCGAACTGGATTCTG | 17 | 96 |
| 756996 | 1124 | 1143 | 49298 | 49317 | ACTCTCCATTATTTCTTCAC | 7 | 97 |
| 756997 | 1126 | 1145 | 49300 | 49319 | ATACTCTCCATTATTTCTTC | 4 | 98 |
| 756998 | 1128 | 1147 | 49302 | 49321 | AAATACTCTCCATTATTTCT | 13 | 99 |
| 756999 | 1129 | 1148 | 49303 | 49322 | AAAATACTCTCCATTATTTC | 34 | 100 |
| 757000 | 1135 | 1154 | 49309 | 49328 | TTGAACAAAATACTCTCCAT | 9 | 101 |
| 757001 | 1141 | 1160 | 49315 | 49334 | GAACATTTGAACAAAATACT | 38 | 102 |

TABLE 1-continued

Percent control of human ATXN2 RNA with 5-10-5 MOE gapmers
with mixed internucleoside linkages at 7,000 nM concentration

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % Control | SEQ ID NO |
|---|---|---|---|---|---|---|---|
| 757002 | 1147 | 1166 | 49321 | 49340 | AAGTCTGAACATTTGAACAA | 12 | 103 |
| 757003 | 1153 | 1172 | 49327 | 49346 | ACAACAAAGTCTGAACATTT | 24 | 104 |
| 757004 | 1159 | 1178 | 49333 | 49352 | TGTACCACAACAAAGTCTGA | 30 | 105 |
| 757005* | 1171 | 1190 | 49345 | 49364 | ATATCTTTAAACTGTACCAC | 7 | 106 |
| 757006* | 1177 | 1196 | 49351 | 49370 | GAGTCCATATCTTTAAACTG | 17 | 107 |

TABLE 2

Percent control of human ATXN2 RNA with 5-10-5 MOE gapmers
with mixed internucleoside linkages at 2,000 nM concentration

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 1 | 32 |
| 708200 | 1478 | 1497 | 81638 | 81657 | TGCTAACTGGTTTGCCCTTG | 14 | 108 |
| 708201 | 1480 | 1499 | 81640 | 81659 | TCTGCTAACTGGTTTGCCCT | 7 | 109 |
| 708203 | 1482 | 1501 | 81642 | 81661 | CTTCTGCTAACTGGTTTGCC | 6 | 110 |
| 755237 | 1562 | 1581 | 81722 | 81741 | TGCTGTGTATTTTTCTTCCT | 4 | 111 |
| 755240 | 1693 | 1712 | 83304 | 83323 | CCCATACGCGGTGAATTCTG | 24 | 112 |
| 757007* | 1183 | 1202 | 49357 | 49376 | TAACTGGAGTCCATATCTTT | 11 | 113 |
| 757008* | 1189 | 1208 | 49363 | 49382 | TTTGCATAACTGGAGTCCAT | 1 | 114 |
| 757009* | 1195 | 1214 | N/A | N/A | TCTCTTTTTGCATAACTGGA | 0 | 115 |
| 757010* | 1201 | 1220 | N/A | N/A | AAAGCATCTCTTTTTGCATA | 10 | 116 |
| 757011* | 1207 | 1226 | N/A | N/A | TCAGTAAAAGCATCTCTTTT | 16 | 117 |
| 757012* | 1213 | 1232 | 76350 | 76369 | GCAGAGTCAGTAAAAGCATC | 3 | 118 |
| 757013* | 1219 | 1238 | 76356 | 76375 | CTGATAGCAGAGTCAGTAAA | 10 | 119 |
| 757014* | 1225 | 1244 | 76362 | 76381 | TTAGCACTGATAGCAGAGTC | 0 | 120 |
| 757015* | 1231 | 1250 | 76368 | 76387 | TTCACTTTAGCACTGATAGC | 3 | 121 |
| 757016* | 1237 | 1256 | 76374 | 76393 | TCGCCATTCACTTTAGCACT | 0 | 122 |
| 757017 | 1258 | 1277 | 76395 | 76414 | TCCAGGTCCTTCTCTTTGTG | 45 | 123 |
| 757018 | 1264 | 1283 | 76401 | 76420 | CAGGGCTCCAGGTCCTTCTC | 17 | 124 |
| 757019 | 1270 | 1289 | 76407 | 76426 | GCATCCCAGGGCTCCAGGTC | 24 | 125 |
| 757020 | 1276 | 1295 | 76413 | 76432 | TCACCTGCATCCCAGGGCTC | 9 | 126 |
| 757021 | 1282 | 1301 | 76419 | 76438 | GTGAGTTCACCTGCATCCCA | 6 | 127 |
| 757022 | 1288 | 1307 | 76425 | 76444 | TTGGCTGTGAGTTCACCTGC | 9 | 128 |
| 757023 | 1294 | 1313 | 76431 | 76450 | TCCTCATTGGCTGTGAGTTC | 14 | 129 |
| 757024 | 1300 | 1319 | 76437 | 76456 | TCAAGTTCCTCATTGGCTGT | 17 | 130 |

TABLE 2-continued

Percent control of human ATXN2 RNA with 5-10-5 MOE gapmers with mixed internucleoside linkages at 2,000 nM concentration

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 757025 | 1312 | 1331 | 76449 | 76468 | TTTTCCAAAGCCTCAAGTTC | 65 | 131 |
| 757026 | 1335 | 1354 | N/A | N/A | GATCCCATCCATTAGATACG | 8 | 132 |
| 757027 | 1350 | 1369 | 80705 | 80724 | GAAACATATCATTGGGATCC | 13 | 133 |
| 757028 | 1356 | 1375 | 80711 | 80730 | TATATCGAAACATATCATTG | 6 | 134 |
| 757029 | 1362 | 1381 | 80717 | 80736 | CTTCATTATATCGAAACATA | 22 | 135 |
| 757030 | 1368 | 1387 | 80723 | 80742 | AATTTTCTTCATTATATCGA | 56 | 136 |
| 757031 | 1374 | 1393 | 80729 | 80748 | CACCATAATTTTCTTCATTA | 14 | 137 |
| 757032 | 1380 | 1399 | 80735 | 80754 | ACACTACACCATAATTTTCT | 20 | 138 |
| 757033 | 1412 | 1431 | N/A | N/A | TGTATACGAAGATAAACTGC | 21 | 139 |
| 757034 | 1430 | 1449 | N/A | N/A | ATCTCTTTCTAAGGGCACTG | 5 | 140 |
| 757035 | 1442 | 1461 | 81602 | 81621 | TTCTTCTGAGTTATCTCTTT | 18 | 141 |
| 757036 | 1448 | 1467 | 81608 | 81627 | TAAAAATTCTTCTGAGTTAT | 80 | 142 |
| 757037 | 1454 | 1473 | 81614 | 81633 | CCGTTTTAAAAATTCTTCTG | 5 | 143 |
| 757038 | 1460 | 1479 | 81620 | 81639 | TGCTTCCCGTTTTAAAAATT | 23 | 144 |
| 757039 | 1466 | 1485 | 81626 | 81645 | TGCCCTTGCTTCCCGTTTTA | 25 | 145 |
| 757040 | 1472 | 1491 | 81632 | 81651 | CTGGTTTGCCCTTGCTTCCC | 6 | 146 |
| 757041 | 1474 | 1493 | 81634 | 81653 | AACTGGTTTGCCCTTGCTTC | 16 | 147 |
| 757042 | 1476 | 1495 | 81636 | 81655 | CTAACTGGTTTGCCCTTGCT | 16 | 148 |
| 757043 | 1484 | 1503 | 81644 | 81663 | TTCTTCTGCTAACTGGTTTG | 21 | 149 |
| 757044 | 1490 | 1509 | 81650 | 81669 | CTCAATTTCTTCTGCTAACT | 35 | 150 |
| 757045 | 1496 | 1515 | 81656 | 81675 | ACTTGACTCAATTTCTTCTG | 4 | 151 |
| 757046 | 1502 | 1521 | 81662 | 81681 | CTGGGCACTTGACTCAATTT | 14 | 152 |
| 757047 | 1508 | 1527 | 81668 | 81687 | TTTGTACTGGGCACTTGACT | 21 | 153 |
| 757048 | 1514 | 1533 | 81674 | 81693 | TCGAGCTTTGTACTGGGCAC | 10 | 154 |
| 757049 | 1520 | 1539 | 81680 | 81699 | GGCCACTCGAGCTTTGTACT | 13 | 155 |
| 757050 | 1526 | 1545 | 81686 | 81705 | TTCCAGGGCCACTCGAGCTT | 8 | 156 |
| 757051 | 1532 | 1551 | 81692 | 81711 | ATCATTTTCCAGGGCCACTC | 14 | 157 |
| 757052 | 1538 | 1557 | 81698 | 81717 | CCTATCATCATTTTCCAGGG | 2 | 158 |
| 757053 | 1544 | 1563 | 81704 | 81723 | CTCACTCCTATCATCATTTT | 13 | 159 |
| 757054 | 1550 | 1569 | 81710 | 81729 | TTCTTCCTCACTCCTATCAT | 61 | 160 |
| 757055 | 1556 | 1575 | 81716 | 81735 | GTATTTTCTTCCTCACTCC | 2 | 161 |
| 757056 | 1568 | 1587 | 81728 | 81747 | CTGAACTGCTGTGTATTTTT | 13 | 162 |
| 757057 | 1574 | 1593 | 81734 | 81753 | ATTTCTCTGAACTGCTGTGT | 2 | 163 |
| 757058 | 1580 | 1599 | 81740 | 81759 | ACTGGAATTTCTCTGAACTG | 10 | 164 |
| 757059 | 1603 | 1622 | 81763 | 81782 | TTTATGCTGTGCCCCTCACG | 42 | 165 |
| 757060 | 1609 | 1628 | 81769 | 81788 | CTAGTGTTTATGCTGTGCCC | 10 | 166 |

TABLE 2-continued

Percent control of human ATXN2 RNA with 5-10-5 MOE gapmers with mixed internucleoside linkages at 2,000 nM concentration

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 757061 | 1615 | 1634 | N/A | N/A | TTTTCCCTAGTGTTTATGCT | 39 | 167 |
| 757062 | 1621 | 1640 | N/A | N/A | TATTTATTTTCCCTAGTGTT | 33 | 168 |
| 757063 | 1633 | 1652 | 83244 | 83263 | CCAGGAGGAATATATTTATT | 16 | 169 |
| 757064 | 1639 | 1658 | 83250 | 83269 | CTTTGTCCAGGAGGAATATA | 19 | 170 |
| 757065 | 1645 | 1664 | 83256 | 83275 | CTATTTCTTTGTCCAGGAGG | 7 | 171 |
| 757066 | 1651 | 1670 | 83262 | 83281 | ACTTCTCTATTTCTTTGTCC | 0 | 172 |
| 757067 | 1657 | 1676 | 83268 | 83287 | GATATGACTTCTCTATTTCT | 13 | 173 |
| 757068 | 1663 | 1682 | 83274 | 83293 | CCCCAGGATATGACTTCTCT | 16 | 174 |
| 757069 | 1669 | 1688 | 83280 | 83299 | CCACTTCCCCAGGATATGAC | 31 | 175 |
| 757070 | 1675 | 1694 | 83286 | 83305 | TGTCTCCCACTTCCCCAGGA | 10 | 176 |
| 757071 | 1681 | 1700 | 83292 | 83311 | GAATTCTGTCTCCCACTTCC | 24 | 177 |
| 757072 | 1687 | 1706 | 83298 | 83317 | CGCGGTGAATTCTGTCTCCC | 3 | 178 |
| 757073 | 1688 | 1707 | 83299 | 83318 | ACGCGGTGAATTCTGTCTCC | 5 | 179 |
| 757074 | 1690 | 1709 | 83301 | 83320 | ATACGCGGTGAATTCTGTCT | 7 | 180 |
| 757075 | 1692 | 1711 | 83303 | 83322 | CCATACGCGGTGAATTCTGT | 6 | 181 |
| 757076 | 1694 | 1713 | 83305 | 83324 | GCCCATACGCGGTGAATTCT | 11 | 182 |
| 757077 | 1696 | 1715 | 83307 | 83326 | TGGCCCATACGCGGTGAATT | 15 | 183 |
| 757078 | 1698 | 1717 | 83309 | 83328 | GCTGGCCCATACGCGGTGAA | 21 | 184 |

TABLE 3

Percent control of human ATXN2 RNA with 5-10-5 MOE gapmers with mixed internucleoside linkages at 2,000 nM concentration

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 8 | 32 |
| 708237 | 1783 | 1802 | 83394 | 83413 | TTAACTACTCTTTGGTCTGA | 36 | 185 |
| 708247 | 1903 | 1922 | 85399 | 85418 | CTGGAGGGCGGCCGTGTAGG | 26 | 186 |
| 708248 | 1957 | 1976 | 85453 | 85472 | GGAGAACCATGAGCAGAGGG | 41 | 187 |
| 755234 | 1963 | 1982 | 85459 | 85478 | GGAGCTGGAGAACCATGAGC | 17 | 188 |
| 755236 | 1969 | 1988 | 85465 | 85484 | GAGACAGGAGCTGGAGAACC | 40 | 189 |
| 755239 | 2099 | 2118 | 88209 | 88228 | GTGGGATACAAATTCTAGGC | 4 | 190 |
| 757079 | 1699 | 1718 | 83310 | 83329 | GGCTGGCCCATACGCGGTGA | 11 | 191 |
| 757080 | 1705 | 1724 | 83316 | 83335 | GATCCAGGCTGGCCCATACG | 42 | 192 |
| 757081 | 1711 | 1730 | 83322 | 83341 | GAGCCCGATCCAGGCTGGCC | 53 | 193 |
| 757082 | 1717 | 1736 | 83328 | 83347 | GGCATGGAGCCCGATCCAGG | 31 | 194 |
| 757083 | 1723 | 1742 | 83334 | 83353 | CTTGATGGCATGGAGCCCGA | 64 | 195 |

TABLE 3-continued

Percent control of human ATXN2 RNA with 5-10-5 MOE gapmers with mixed internucleoside linkages at 2,000 nM concentration

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 757084 | 1729 | 1748 | 83340 | 83359 | GTGGATCTTGATGGCATGGA | 23 | 196 |
| 757085 | 1735 | 1754 | 83346 | 83365 | TGAGAAGTGGATCTTGATGG | 58 | 197 |
| 757086 | 1741 | 1760 | 83352 | 83371 | GAAGTGTGAGAAGTGGATCT | 49 | 198 |
| 757087 | 1747 | 1766 | 83358 | 83377 | AAATCTGAAGTGTGAGAAGT | 71 | 199 |
| 757088 | 1753 | 1772 | 83364 | 83383 | GGGTTGAAATCTGAAGTGTG | 24 | 200 |
| 757089 | 1765 | 1784 | 83376 | 83395 | GAACCAGAATTCGGGTTGAA | 8 | 201 |
| 757090 | 1771 | 1790 | 83382 | 83401 | TGGTCTGAACCAGAATTCGG | 31 | 202 |
| 757091 | 1777 | 1796 | 83388 | 83407 | ACTCTTTGGTCTGAACCAGA | 47 | 203 |
| 757092 | 1789 | 1808 | 83400 | 83419 | CCTCCATTAACTACTCTTTG | 19 | 204 |
| 757093 | 1795 | 1814 | N/A | N/A | GGAACACCTCCATTAACTAC | 34 | 205 |
| 757094 | 1807 | 1826 | 85303 | 85322 | GGCGATGGCCAGGGAACACC | 3 | 206 |
| 757095 | 1814 | 1833 | 85310 | 85329 | TGGGCAAGGCGATGGCCAGG | 58 | 207 |
| 757096 | 1820 | 1839 | 85316 | 85335 | AGGAGATGGGCAAGGCGATG | 60 | 208 |
| 757097 | 1826 | 1845 | 85322 | 85341 | AGAGGAAGGAGATGGGCAAG | 51 | 209 |
| 757098 | 1832 | 1851 | 85328 | 85347 | TGGGCGAGAGGAAGGAGATG | 37 | 210 |
| 757099 | 1838 | 1857 | 85334 | 85353 | AGAAGGTGGGCGAGAGGAAG | 130 | 211 |
| 757100 | 1844 | 1863 | 85340 | 85359 | GTAGCGAGAAGGTGGGCGAG | 35 | 212 |
| 757101 | 1850 | 1869 | 85346 | 85365 | TGACTGGTAGCGAGAAGGTG | 65 | 213 |
| 757102 | 1856 | 1875 | 85352 | 85371 | GGGACCTGACTGGTAGCGAG | 39 | 214 |
| 757103 | 1862 | 1881 | 85358 | 85377 | AGAGTTGGGACCTGACTGGT | 28 | 215 |
| 757104 | 1868 | 1887 | 85364 | 85383 | TGGAAGAGAGTTGGGACCTG | 10 | 216 |
| 757105 | 1874 | 1893 | 85370 | 85389 | CCGAGGTGGAAGAGAGTTGG | 153 | 217 |
| 757106 | 1880 | 1899 | 85376 | 85395 | GGCTGCCCGAGGTGGAAGAG | 12 | 218 |
| 757107 | 1927 | 1946 | 85423 | 85442 | GGTCTGGATGGCCGCGAGGG | 20 | 219 |
| 757108 | 1958 | 1977 | 85454 | 85473 | TGGAGAACCATGAGCAGAGG | 26 | 220 |
| 757109 | 1960 | 1979 | 85456 | 85475 | GCTGGAGAACCATGAGCAGA | 24 | 221 |
| 757110 | 1962 | 1981 | 85458 | 85477 | GAGCTGGAGAACCATGAGCA | 34 | 222 |
| 757111 | 1964 | 1983 | 85460 | 85479 | AGGAGCTGGAGAACCATGAG | 26 | 223 |
| 757112 | 1966 | 1985 | 85462 | 85481 | ACAGGAGCTGGAGAACCATG | 26 | 224 |
| 757113 | 1968 | 1987 | 85464 | 85483 | AGACAGGAGCTGGAGAACCA | 12 | 225 |
| 757114 | 1975 | 1994 | 85471 | 85490 | ATAGTAGAGACAGGAGCTGG | 42 | 226 |
| 757115 | 1981 | 2000 | 85477 | 85496 | TTAGGCATAGTAGAGACAGG | 66 | 227 |
| 757116 | 2002 | 2021 | N/A | N/A | GGCCCTTCTGAAGACATGCG | 9 | 228 |
| 757117 | 2008 | 2027 | N/A | N/A | CTTGGAGGCCCTTCTGAAGA | 105 | 229 |
| 757118 | 2014 | 2033 | N/A | N/A | GACATCCTTGGAGGCCCTTC | 29 | 230 |
| 757119 | 2035 | 2054 | 88145 | 88164 | GGATGTCGCTGGGCCTTTGG | 48 | 231 |

TABLE 3-continued

Percent control of human ATXN2 RNA with 5-10-5 MOE gapmers with mixed internucleoside linkages at 2,000 nM concentration

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 757120 | 2041 | 2060 | 88151 | 88170 | TTTCGAGGATGTCGCTGGGC | 28 | 232 |
| 757121 | 2047 | 2066 | 88157 | 88176 | CTGTGATTTCGAGGATGTCG | 40 | 233 |
| 757122 | 2053 | 2072 | 88163 | 88182 | GAAACTCTGTGATTTCGAGG | 28 | 234 |
| 757123 | 2059 | 2078 | 88169 | 88188 | CCAGCAGAAACTCTGTGATT | 49 | 235 |
| 757124 | 2065 | 2084 | 88175 | 88194 | CCCCTCCCAGCAGAAACTCT | 20 | 236 |
| 757125 | 2071 | 2090 | 88181 | 88200 | ATGGAACCCCTCCCAGCAGA | 31 | 237 |
| 757126 | 2077 | 2096 | 88187 | 88206 | CTGGATATGGAACCCCTCCC | 26 | 238 |
| 757127 | 2083 | 2102 | 88193 | 88212 | AGGCCACTGGATATGGAACC | 5 | 239 |
| 757128 | 2089 | 2108 | 88199 | 88218 | AATTCTAGGCCACTGGATAT | 38 | 240 |
| 757129 | 2094 | 2113 | 88204 | 88223 | ATACAAATTCTAGGCCACTG | 9 | 241 |
| 757130 | 2096 | 2115 | 88206 | 88225 | GGATACAAATTCTAGGCCAC | 5 | 242 |
| 757131 | 2098 | 2117 | 88208 | 88227 | TGGGATACAAATTCTAGGCC | 4 | 243 |
| 757132 | 2100 | 2119 | 88210 | 88229 | TGTGGGATACAAATTCTAGG | 31 | 244 |
| 757133 | 2102 | 2121 | 88212 | 88231 | GTTGTGGGATACAAATTCTA | 39 | 245 |
| 757134 | 2122 | 2141 | 88232 | 88251 | GTAGCTGCTTCACTGGGTGG | 53 | 246 |
| 757135 | 2128 | 2147 | 88238 | 88257 | GGAGGAGTAGCTGCTTCACT | 15 | 247 |
| 757136 | 2134 | 2153 | 88244 | 88263 | GCTACTGGAGGAGTAGCTGC | 50 | 248 |
| 757137 | 2140 | 2159 | 88250 | 88269 | GTCCTTGCTACTGGAGGAGT | 35 | 249 |
| 757138 | 2146 | 2165 | 88256 | 88275 | GGACTGGTCCTTGCTACTGG | 18 | 250 |
| 757139 | 2152 | 2171 | 88262 | 88281 | CCCGAGGGACTGGTCCTTGC | 18 | 251 |
| 757140 | 2158 | 2177 | 88268 | 88287 | GTTCCCCCCGAGGGACTGGT | 33 | 252 |
| 757141 | 2177 | 2196 | 88287 | 88306 | ACTGACCACTGATGACCACG | 34 | 253 |
| 757142 | 2183 | 2202 | N/A | N/A | AACCCCACTGACCACTGATG | 85 | 254 |
| 757143 | 2189 | 2208 | N/A | N/A | TCTTGGAACCCCACTGACCA | 62 | 255 |
| 757144 | 2195 | 2214 | N/A | N/A | GGATAATCTTGGAACCCCAC | 51 | 256 |
| 757145 | 2215 | 2234 | 91099 | 91118 | CTGGGTCTATGAGTTTTAGG | 28 | 257 |
| 757146 | 2221 | 2240 | 91105 | 91124 | GGAGACCTGGGTCTATGAGT | 17 | 258 |
| 757147 | 2231 | 2250 | 91115 | 91134 | GTTCTGTCTGGGAGACCTGG | 13 | 259 |
| 757148 | 2237 | 2256 | 91121 | 91140 | AATACTGTTCTGTCTGGGAG | 25 | 260 |
| 757149 | 2243 | 2262 | 91127 | 91146 | ATTTCCAATACTGTTCTGTC | 18 | 261 |

TABLE 4

Percent control of human ATXN2 RNA with 5-10-5 MOE gapmers with mixed internucleoside linkages at 2,000 nM concentration

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 26 | 32 |
| 757150 | 2266 | 2285 | 91150 | 91169 | GCAAGAACTGGCCCACTGGG | 90 | 262 |
| 757151 | 2272 | 2291 | 91156 | 91175 | GGAGAAGCAAGAACTGGCCC | 73 | 263 |
| 757152 | 2291 | 2310 | 91175 | 91194 | TGGAATAATACCAGCTTGGG | 39 | 264 |
| 757153 | 2297 | 2316 | 91181 | 91200 | TTCAGTTGGAATAATACCAG | 105 | 265 |
| 757154 | 2303 | 2322 | 91187 | 91206 | AACAGCTTCAGTTGGAATAA | 59 | 266 |
| 757155 | 2309 | 2328 | 91193 | 91212 | CATGGCAACAGCTTCAGTTG | 66 | 267 |
| 757156 | 2315 | 2334 | 91199 | 91218 | AATAGGCATGGCAACAGCTT | 44 | 268 |
| 757157 | 2321 | 2340 | 91205 | 91224 | AGCTGGAATAGGCATGGCAA | 32 | 269 |
| 757158 | 2327 | 2346 | 91211 | 91230 | AGATGCAGCTGGAATAGGCA | 129 | 270 |
| 757159 | 2333 | 2352 | 91217 | 91236 | CGTAGGAGATGCAGCTGGAA | 32 | 271 |
| 757160 | 2351 | 2370 | 91235 | 91254 | CGATGCAGGACTAGCAGGCG | 26 | 272 |
| 757161 | 2357 | 2376 | 91241 | 91260 | TCTGTTCGATGCAGGACTAG | 23 | 273 |
| 757162 | 2363 | 2382 | 91247 | 91266 | AACAGCTCTGTTCGATGCAG | 23 | 274 |
| 757163 | 2391 | 2410 | N/A | N/A | TGGAATCTTTAGCCTCACTA | 67 | 275 |
| 757164 | 2397 | 2416 | N/A | N/A | GAAGCCTGGAATCTTTAGCC | 59 | 276 |
| 757165 | 2403 | 2422 | 91673 | 91692 | GATCTTGAAGCCTGGAATCT | 67 | 277 |
| 757166 | 2409 | 2428 | 91679 | 91698 | GCCTCTGATCTTGAAGCCTG | 56 | 278 |
| 757167 | 2415 | 2434 | 91685 | 91704 | AGTTCTGCCTCTGATCTTGA | 80 | 279 |
| 757168 | 2421 | 2440 | 91691 | 91710 | CAGGAGAGTTCTGCCTCTGA | 131 | 280 |
| 757169 | 2427 | 2446 | 91697 | 91716 | TCCCTGCAGGAGAGTTCTGC | 59 | 281 |
| 757170 | 2433 | 2452 | 91703 | 91722 | CTTTATTCCCTGCAGGAGAG | 79 | 282 |
| 757171 | 2439 | 2458 | 91709 | 91728 | TATTTTCTTTATTCCCTGCA | 56 | 283 |
| 757172 | 2445 | 2464 | 91715 | 91734 | GTTTAATATTTTCTTTATTC | 89 | 284 |
| 757173 | 2451 | 2470 | 91721 | 91740 | CATTGGGTTTAATATTTTCT | 54 | 285 |
| 757174 | 2457 | 2476 | 91727 | 91746 | ATGTTTCATTGGGTTTAATA | 39 | 286 |
| 757175 | 2463 | 2482 | 91733 | 91752 | TAGGTGATGTTTCATTGGGT | 23 | 287 |
| 757176 | 2469 | 2488 | 91739 | 91758 | AGAAGCTAGGTGATGTTTCA | 81 | 288 |
| 757177 | 2475 | 2494 | 91745 | 91764 | CTTTTGAGAAGCTAGGTGAT | 90 | 289 |
| 757178 | 2481 | 2500 | 91751 | 91770 | TTTCAGCTTTTGAGAAGCTA | 61 | 290 |
| 757179 | 2487 | 2506 | 91757 | 91776 | CTTTGTTTTCAGCTTTTGAG | 35 | 291 |
| 757180 | 2493 | 2512 | N/A | N/A | ATATACCTTTGTTTTCAGCT | 31 | 292 |
| 757181 | 2499 | 2518 | N/A | N/A | CTGGTGATATACCTTTGTTT | 42 | 293 |
| 757182 | 2505 | 2524 | 92046 | 92065 | AAACAACTGGTGATATACCT | 132 | 294 |
| 757183 | 2511 | 2530 | 92052 | 92071 | GTTCAGAAACAACTGGTGAT | 39 | 295 |
| 757184 | 2517 | 2536 | 92058 | 92077 | TTCTATGTTCAGAAACAACT | 37 | 296 |

TABLE 4-continued

Percent control of human ATXN2 RNA with 5-10-5 MOE gapmers with mixed internucleoside linkages at 2,000 nM concentration

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 757185 | 2523 | 2542 | 92064 | 92083 | TCTGTTTTCTATGTTCAGAA | 58 | 297 |
| 757186 | 2529 | 2548 | 92070 | 92089 | CATCAATCTGTTTTCTATGT | 38 | 298 |
| 757187 | 2535 | 2554 | 92076 | 92095 | TTAAATCATCAATCTGTTTT | 122 | 299 |
| 757188 | 2541 | 2560 | 92082 | 92101 | ATTTCTTTAAATCATCAATC | 86 | 300 |
| 757189 | 2547 | 2566 | 92088 | 92107 | TCTTAAATTTCTTTAAATCA | 128 | 301 |
| 757190 | 2553 | 2572 | 92094 | 92113 | AATCATTCTTAAATTTCTTT | 55 | 302 |
| 757191 | 2559 | 2578 | N/A | N/A | ACCTAAAATCATTCTTAAAT | 141 | 303 |
| 757192 | 2565 | 2584 | N/A | N/A | GCTGTAACCTAAAATCATTC | 64 | 304 |
| 757193 | 2571 | 2590 | N/A | N/A | AACTTGGCTGTAACCTAAAA | 84 | 305 |
| 757194 | 2577 | 2596 | 112886 | 112905 | AAGTAGAACTTGGCTGTAAC | 59 | 306 |
| 757195 | 2583 | 2602 | 112892 | 112911 | ATTCAGAAGTAGAACTTGGC | 82 | 307 |
| 757196 | 2589 | 2608 | 112898 | 112917 | CCATAGATTCAGAAGTAGAA | 63 | 308 |
| 757197 | 2595 | 2614 | 112904 | 112923 | GTTGATCCATAGATTCAGAA | 61 | 309 |
| 757198 | 2601 | 2620 | 112910 | 112929 | TTAGTAGTTGATCCATAGAT | 50 | 310 |
| 757199 | 2607 | 2626 | 112916 | 112935 | TTTTGTTTAGTAGTTGATCC | 104 | 311 |
| 757200 | 2613 | 2632 | 112922 | 112941 | CTCTATTTTGTTTAGTAGT | 26 | 312 |
| 757201 | 2619 | 2638 | 112928 | 112947 | CTCCCTCTCTATTTTGTTT | 57 | 313 |
| 757202 | 2625 | 2644 | 112934 | 112953 | ATTTTTCTCCCTCTCTATTT | 115 | 314 |
| 757203 | 2631 | 2650 | 112940 | 112959 | CTCTTGATTTTTCTCCCTCT | 39 | 315 |
| 757204 | 2637 | 2656 | 112946 | 112965 | TCAAATCTCTTGATTTTTCT | 49 | 316 |
| 757205 | 2643 | 2662 | 112952 | 112971 | CTTTGATCAAATCTCTTGAT | 59 | 317 |
| 757206 | 2649 | 2668 | 112958 | 112977 | TTTTGTCTTTGATCAAATCT | 60 | 318 |
| 757207 | 2655 | 2674 | 112964 | 112983 | GTTCAATTTTGTCTTTGATC | 33 | 319 |
| 757208 | 2661 | 2680 | 112970 | 112989 | CACTTGGTTCAATTTTGTCT | 31 | 320 |
| 757209 | 2667 | 2686 | 112976 | 112995 | CCTTAGCACTTGGTTCAATT | 20 | 321 |
| 757210 | 2673 | 2692 | 112982 | 113001 | AAGAATCCTTAGCACTTGGT | 20 | 322 |
| 757211 | 2679 | 2698 | 112988 | 113007 | CAATGAAAGAATCCTTAGCA | 28 | 323 |
| 757212 | 2685 | 2704 | 112994 | 113013 | TATTTTCAATGAAAGAATCC | 83 | 324 |
| 757213 | 2691 | 2710 | 113000 | 113019 | TGCTGCTATTTTCAATGAAA | 20 | 325 |
| 757214 | 2697 | 2716 | 113006 | 113025 | AGTTGCTGCTGCTATTTTCA | 37 | 326 |
| 757215 | 2699 | 2718 | 113008 | 113027 | ACAGTTGCTGCTGCTATTTT | 50 | 327 |
| 757216 | 2701 | 2720 | 113010 | 113029 | GTACAGTTGCTGCTGCTATT | 36 | 328 |
| 757217 | 2703 | 2722 | 113012 | 113031 | TGGTACAGTTGCTGCTGCTA | 50 | 329 |
| 757218 | 2704 | 2723 | 113013 | 113032 | CTGGTACAGTTGCTGCTGCT | 17 | 330 |
| 757219 | 2705 | 2724 | 113014 | 113033 | ACTGGTACAGTTGCTGCTGC | 21 | 331 |
| 757220 | 2707 | 2726 | 113016 | 113035 | CCACTGGTACAGTTGCTGCT | 43 | 332 |

TABLE 4-continued

Percent control of human ATXN2 RNA with 5-10-5 MOE gapmers with mixed internucleoside linkages at 2,000 nM concentration

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 757221 | 2709 | 2728 | 113018 | 113037 | TGCCACTGGTACAGTTGCTG | 54 | 333 |
| 757222 | 2715 | 2734 | 113024 | 113043 | TGCTGCTGCCACTGGTACAG | 55 | 334 |
| 757223 | 2721 | 2740 | 113030 | 113049 | TCGGCTTGCTGCTGCCACTG | 37 | 335 |
| 757224 | 2727 | 2746 | 113036 | 113055 | GGCTATTCGGCTTGCTGCTG | 29 | 336 |
| 757225 | 2757 | 2776 | 113066 | 113085 | TGTTACTAAGTATTGAAGGG | 54 | 337 |
| 757226 | 2763 | 2782 | 113072 | 113091 | GCTCCGTGTTACTAAGTATT | 22 | 338 |

TABLE 5

Percent control of human ATXN2 RNA with 5-10-5 MOE gapmers with mixed internucleoside linkages at 2,000 nM concentration

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 29 | 32 |
| 757227 | 2769 | 2788 | 113078 | 113097 | TCTTGTGCTCCGTGTTACTA | 48 | 339 |
| 757228 | 2775 | 2794 | 113084 | 113103 | GTCCCTCTTGTGCTCCGTG | 28 | 340 |
| 757229 | 2781 | 2800 | 113090 | 113109 | CCTCAGGTCCCTCTTGTGC | 66 | 341 |
| 757230 | 2787 | 2806 | 113096 | 113115 | AAGTGACCTCAGGTCCCCTC | 116 | 342 |
| 757231 | 2793 | 2812 | 113102 | 113121 | CTTGGGAAGTGACCTCAGGT | 37 | 343 |
| 757232 | 2799 | 2818 | 113108 | 113127 | GAACCCCTTGGGAAGTGACC | 39 | 344 |
| 757233 | 2805 | 2824 | 113114 | 113133 | AAGTCTGAACCCCTTGGGAA | 47 | 345 |
| 757234 | 2811 | 2830 | 113120 | 113139 | GGCTGGAAGTCTGAACCCCT | 28 | 346 |
| 757235 | 2817 | 2836 | 113126 | 113145 | ATGCTGGGCTGGAAGTCTGA | 63 | 347 |
| 757236 | 2823 | 2842 | 113132 | 113151 | GTTTACATGCTGGGCTGGAA | 31 | 348 |
| 757237 | 2829 | 2848 | 113138 | 113157 | TCTCTTGTTTACATGCTGGG | 47 | 349 |
| 757238 | 2835 | 2854 | 113144 | 113163 | CGTCTTTCTCTTGTTTACAT | 33 | 350 |
| 757239 | 2853 | 2872 | 113162 | 113181 | CTTTCTTCTCTTCCTTATCG | 74 | 351 |
| 757240 | 2874 | 2893 | N/A | N/A | TCCTAACTTGCTCAGCTGCG | 36 | 352 |
| 757241 | 2882 | 2901 | N/A | N/A | TGTTGATTTCCTAACTTGCT | 64 | 353 |
| 757242 | 2888 | 2907 | 114848 | 114867 | ATTCAATGTTGATTTCCTAA | 52 | 354 |
| 757243 | 2897 | 2916 | 114857 | 114876 | TGCATTGGGATTCAATGTTG | 41 | 355 |
| 757244 | 2913 | 2932 | 114873 | 114892 | GTGGGTTGAACTCCTTTGCA | 89 | 356 |
| 757245 | 2932 | 2951 | N/A | N/A | TTTGGCTGAGAGAAGGAACG | 79 | 357 |
| 757246 | 2938 | 2957 | N/A | N/A | GAAGGCTTTGGCTGAGAGAA | 88 | 358 |
| 757247 | 2944 | 2963 | N/A | N/A | GTAGTAGAAGGCTTTGGCTG | 58 | 359 |
| 757248 | 2964 | 2983 | 115819 | 115838 | GAGGCCGAGGTGAAGTTGGG | 50 | 360 |
| 757249 | 2970 | 2989 | 115825 | 115844 | GTGCTTGAGGCCGAGGTGAA | 49 | 361 |

TABLE 5-continued

Percent control of human ATXN2 RNA with 5-10-5 MOE gapmers with mixed internucleoside linkages at 2,000 nM concentration

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 757250 | 2976 | 2995 | 115831 | 115850 | TAGGTTGTGCTTGAGGCCGA | 29 | 362 |
| 757251 | 2982 | 3001 | 115837 | 115856 | ATGGGCTAGGTTGTGCTTGA | 48 | 363 |
| 757252 | 2988 | 3007 | 115843 | 115862 | CCATAGATGGGCTAGGTTGT | 84 | 364 |
| 757253 | 2994 | 3013 | 115849 | 115868 | GACCCACCATAGATGGGCTA | 87 | 365 |
| 757254 | 3000 | 3019 | 115855 | 115874 | GTTGATGACCCACCATAGAT | 88 | 366 |
| 757255 | 3006 | 3025 | 115861 | 115880 | TTGGCTGTTGATGACCCACC | 91 | 367 |
| 757256 | 3012 | 3031 | 115867 | 115886 | CTGGAGTTGGCTGTTGATGA | 101 | 368 |
| 757257 | 3018 | 3037 | 115873 | 115892 | TATAAACTGGAGTTGGCTGT | 84 | 369 |
| 757258 | 3024 | 3043 | 115879 | 115898 | GCTGAGTATAAACTGGAGTT | 52 | 370 |
| 757259 | 3030 | 3049 | 115885 | 115904 | AAACAGGCTGAGTATAAACT | 114 | 371 |
| 757260 | 3036 | 3055 | 115891 | 115910 | CAAAACAAACAGGCTGAGTA | 53 | 372 |
| 757261 | 3042 | 3061 | 115897 | 115916 | TTGGTGCAAAACAAACAGGC | 75 | 373 |
| 757262 | 3048 | 3067 | 115903 | 115922 | TCATATTTGGTGCAAAACAA | 74 | 374 |
| 757263 | 3054 | 3073 | 115909 | 115928 | GATACATCATATTTGGTGCA | 32 | 375 |
| 757264 | 3060 | 3079 | 115915 | 115934 | GGACTGGATACATCATATTT | 94 | 376 |
| 757265 | 3066 | 3085 | 115921 | 115940 | TCACTGGGACTGGATACATC | 83 | 377 |
| 757266 | 3079 | 3098 | 115934 | 115953 | TGCACGCCTGGGCTCACTGG | 70 | 378 |
| 757267 | 3085 | 3104 | N/A | N/A | AAAGGTTGCACGCCTGGGCT | 27 | 379 |
| 757268 | 3091 | 3110 | N/A | N/A | GGGTATAAAGGTTGCACGCC | 97 | 380 |
| 757269 | 3097 | 3116 | N/A | N/A | GGTATTGGGTATAAAGGTTG | 32 | 381 |
| 757270 | 3103 | 3122 | 116339 | 116358 | GTCATAGGTATTGGGTATAA | 60 | 382 |
| 757271 | 3122 | 3141 | 116358 | 116377 | TTGATTCACTGGCATGGGCG | 78 | 383 |
| 757272 | 3128 | 3147 | 116364 | 116383 | CTTGGCTTGATTCACTGGCA | 30 | 384 |
| 757273 | 3134 | 3153 | 116370 | 116389 | ATATGTCTTGGCTTGATTCA | 68 | 385 |
| 757274 | 3140 | 3159 | 116376 | 116395 | TGCTCTATATGTCTTGGCTT | 51 | 386 |
| 757275 | 3146 | 3165 | N/A | N/A | TGGTACTGCTCTATATGTCT | 42 | 387 |
| 757276 | 3152 | 3171 | N/A | N/A | CATATTTGGTACTGCTCTAT | 105 | 388 |
| 757277 | 3173 | 3192 | 130937 | 130956 | CTGGTCTTGCCGCTGTTGGG | 48 | 389 |
| 757278 | 3179 | 3198 | 130943 | 130962 | ATGATGCTGGTCTTGCCGCT | 49 | 390 |
| 757279 | 3185 | 3204 | 130949 | 130968 | ACTCTGATGATGCTGGTCTT | 98 | 391 |
| 757280 | 3191 | 3210 | 130955 | 130974 | CATGGCACTCTGATGATGCT | 120 | 392 |
| 757281 | 3197 | 3216 | 130961 | 130980 | GTGCATCATGGCACTCTGAT | 42 | 393 |
| 757282 | 3203 | 3222 | 130967 | 130986 | CGCTGGGTGCATCATGGCAC | 37 | 394 |
| 757283 | 3220 | 3239 | 130984 | 131003 | GGTGGGCCCGCTGCTGACGC | 60 | 395 |
| 757284 | 3226 | 3245 | 130990 | 131009 | GCAATCGGTGGGCCCGCTGC | 62 | 396 |
| 757285 | 3232 | 3251 | 130996 | 131015 | GTGGCTGCAATCGGTGGGCC | 57 | 397 |

TABLE 5-continued

Percent control of human ATXN2 RNA with 5-10-5 MOE gapmers with mixed internucleoside linkages at 2,000 nM concentration

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 757286 | 3269 | 3288 | 131033 | 131052 | ACTGTAGGCAACATATTGCG | 108 | 398 |
| 757287 | 3275 | 3294 | 131039 | 131058 | CTGAGGACTGTAGGCAACAT | 48 | 399 |
| 757288 | 3311 | 3330 | 131075 | 131094 | TGGCACATGCTGAACAAGGG | 32 | 400 |
| 757289 | 3317 | 3336 | 131081 | 131100 | ATAATGTGGCACATGCTGAA | 138 | 401 |
| 757290 | 3323 | 3342 | 131087 | 131106 | AGACTGATAATGTGGCACAT | 64 | 402 |
| 757291 | 3329 | 3348 | N/A | N/A | ATGCTGAGACTGATAATGTG | 77 | 403 |
| 757292 | 3335 | 3354 | N/A | N/A | ATGAGGATGCTGAGACTGAT | 81 | 404 |
| 757293 | 3341 | 3360 | N/A | N/A | ATAGACATGAGGATGCTGAG | 85 | 405 |
| 757294 | 3347 | 3366 | 131428 | 131447 | AGGACTATAGACATGAGGAT | 25 | 406 |
| 757295 | 3353 | 3372 | 131434 | 131453 | TATTACAGGACTATAGACAT | 58 | 407 |
| 757296 | 3359 | 3378 | 131440 | 131459 | ACCCTGTATTACAGGACTAT | 81 | 408 |
| 757297 | 3365 | 3384 | 131446 | 131465 | AGCATTACCCTGTATTACAG | 45 | 409 |
| 757298 | 3371 | 3390 | 131452 | 131471 | CATTCTAGCATTACCCTGTA | 90 | 410 |
| 757299 | 3377 | 3396 | 131458 | 131477 | TGCCATCATTCTAGCATTAC | 73 | 411 |
| 757300 | 3383 | 3402 | 131464 | 131483 | TGGTGGTGCCATCATTCTAG | 51 | 412 |
| 757301 | 3408 | 3427 | 131489 | 131508 | ATACTAAACCAGGCTGGGCG | 85 | 413 |
| 757302 | 3414 | 3433 | 131495 | 131514 | AAGAAGATACTAAACCAGGC | 41 | 414 |
| 757303 | 3420 | 3439 | 131501 | 131520 | TTGCTGAAGAAGATACTAAA | 81 | 415 |

TABLE 6

Percent control of human ATXN2 RNA with 5-10-5 MOE gapmers with mixed internucleoside linkages at 2,000 nM concentration

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 19 | 32 |
| 708398 | 3476 | 3495 | N/A | N/A | TGGTAATTTGGGACATGCAT | 45 | 416 |
| 708400 | 3494 | 3513 | 136967 147866 | 136986 147885 | GCTTGTCTCCTTGTTGTATG | 49 | 417 |
| 708435 | 3897 | 3916 | N/A | N/A | GTACATGAGCCTGAGGTACG | 112 | 418 |
| 708440 | 3951 | 3970 | N/A | N/A | TCATTAGCATCATTGGCGCA | 49 | 419 |
| 757304 | 3426 | 3445 | 131507 | 131526 | ACTGAGTTGCTGAAGAAGAT | 85 | 420 |
| 757305 | 3432 | 3451 | 131513 | 131532 | CCCCGTACTGAGTTGCTGAA | 63 | 421 |
| 757306 | 3438 | 3457 | 131519 | 131538 | CATGAGCCCCGTACTGAGTT | 79 | 422 |
| 757307 | 3444 | 3463 | 131525 | 131544 | TCTGCTCATGAGCCCCGTAC | 70 | 423 |
| 757308 | 3464 | 3483 | N/A | N/A | ACATGCATACATCGCATGCG | 98 | 424 |
| 757309 | 3470 | 3489 | N/A | N/A | TTTGGGACATGCATACATCG | 111 | 425 |

TABLE 6-continued

Percent control of human ATXN2 RNA with 5-10-5 MOE gapmers with mixed internucleoside linkages at 2,000 nM concentration

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
| --- | --- | --- | --- | --- | --- | --- | --- |
| 757310 | 3482 | 3501 | 136955 | 136974 | GTTGTATGGTAATTTGGGAC | 56 | 426 |
| 757311 | 3488 | 3507 | 136961 | 136980 | CTCCTTGTTGTATGGTAATT | 32 | 427 |
| 757312 | 3500 | 3519 | 136973 | 136992 | AGAAGGGCTTGTCTCCTTGT | 63 | 428 |
| 757313 | 3506 | 3525 | 136979 | 136998 | GTAGAAAGAAGGGCTTGTCT | 70 | 429 |
| 757314 | 3512 | 3531 | 136985 | 137004 | GGCAAAGTAGAAAGAAGGGC | 54 | 430 |
| 757315 | 3518 | 3537 | N/A | N/A | GGAAATGGCAAAGTAGAAAG | 97 | 431 |
| 757316 | 3524 | 3543 | N/A | N/A | GCCCGTGGAAATGGCAAAGT | 97 | 432 |
| 757317 | 3530 | 3549 | N/A | N/A | AAGGGAGCCCGTGGAAATGG | 74 | 433 |
| 757318 | 3536 | 3555 | 144311 | 144330 | CTGAGCAAGGGAGCCCGTGG | 82 | 434 |
| 757319 | 3542 | 3561 | 144317 | 144336 | ATACTGCTGAGCAAGGGAGC | 54 | 435 |
| 757320 | 3548 | 3567 | 144323 | 144342 | GTGCGCATACTGCTGAGCAA | 61 | 436 |
| 757321 | 3554 | 3573 | 144329 | 144348 | GTTAGGGTGCGCATACTGCT | 52 | 437 |
| 757322 | 3579 | 3598 | 144354 | 144373 | GTGGAGTATGTGGGTGCAGG | 89 | 438 |
| 757323 | 3586 | 3605 | 144361 | 144380 | TGAGGGTGTGGAGTATGTGG | 94 | 439 |
| 757324 | 3592 | 3611 | 144367 | 144386 | GAAGGCTGAGGGTGTGGAGT | 85 | 440 |
| 757325 | 3598 | 3617 | 144373 | 144392 | GTAGCTGAAGGCTGAGGGTG | 70 | 441 |
| 757326 | 3619 | 3638 | 144394 | 144413 | CTTTGCTGCTGTCCAGTGGG | 43 | 442 |
| 757327 | 3625 | 3644 | 144400 | 144419 | TGTTGGCTTTGCTGCTGTCC | 55 | 443 |
| 757328 | 3631 | 3650 | 144406 | 144425 | CCACCATGTTGGCTTTGCTG | 60 | 444 |
| 757329 | 3637 | 3656 | 144412 | 144431 | TGACTTCCACCATGTTGGCT | 64 | 445 |
| 757330 | 3643 | 3662 | 144418 | 144437 | GCAGGATGACTTCCACCATG | 62 | 446 |
| 757331 | 3649 | 3668 | 144424 | 144443 | CTGGGTGCAGGATGACTTCC | 61 | 447 |
| 757332 | 3656 | 3675 | 144431 | 144450 | AACAGGACTGGGTGCAGGAT | 80 | 448 |
| 757333 | 3666 | 3685 | N/A | N/A | GATGGTGCTGAACAGGACTG | 67 | 449 |
| 757334 | 3672 | 3691 | N/A | N/A | GGTGCTGATGGTGCTGAACA | 64 | 450 |
| 757335 | 3678 | 3697 | 145410 | 145429 | CGGCCTGGTGCTGATGGTGC | 50 | 451 |
| 757336 | 3684 | 3703 | 145416 | 145435 | CCTGGGCGGCCTGGTGCTGA | 64 | 452 |
| 757337 | 3690 | 3709 | 145422 | 145441 | GGAGAGCCTGGGCGGCCTGG | 74 | 453 |
| 757338 | 3696 | 3715 | 145428 | 145447 | CCAGATGGAGAGCCTGGGCG | 81 | 454 |
| 757339 | 3702 | 3721 | 145434 | 145453 | GACTGGCCAGATGGAGAGCC | 82 | 455 |
| 757340 | 3708 | 3727 | 145440 | 145459 | GCTGTGGACTGGCCAGATGG | 84 | 456 |
| 757341 | 3714 | 3733 | 145446 | 145465 | ACTGCTGCTGTGGACTGGCC | 62 | 457 |
| 757342 | 3720 | 3739 | 145452 | 145471 | TGGCTGACTGCTGCTGTGGA | 42 | 458 |
| 757343 | 3726 | 3745 | 145458 | 145477 | GGTAAATGGCTGACTGCTGC | 54 | 459 |
| 757344 | 3747 | 3766 | 145479 | 145498 | GAGTTGGCGCAAGCCCCGCG | 62 | 460 |
| 757345 | 3753 | 3772 | 145485 | 145504 | AGGGTGGAGTTGGCGCAAGC | 88 | 461 |

TABLE 6-continued

Percent control of human ATXN2 RNA with 5-10-5 MOE gapmers with mixed internucleoside linkages at 2,000 nM concentration

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 757346 | 3759 | 3778 | 145491 | 145510 | TCATGGAGGGTGGAGTTGGC | 97 | 462 |
| 757347 | 3765 | 3784 | 145497 | 145516 | CAGGTGTCATGGAGGGTGGA | 103 | 463 |
| 757348 | 3771 | 3790 | 145503 | 145522 | TGGAGGCAGGTGTCATGGAG | 111 | 464 |
| 757349 | 3794 | 3813 | 145526 | 145545 | ACTATTCTGTGGCGACTGCG | 57 | 465 |
| 757350 | 3800 | 3819 | 145532 | 145551 | TGGGAAACTATTCTGTGGCG | 61 | 466 |
| 757351 | 3806 | 3825 | 145538 | 145557 | TGCTGCTGGGAAACTATTCT | 71 | 467 |
| 757352 | 3812 | 3831 | 145544 | 145563 | CTGTTGTGCTGCTGGGAAAC | 57 | 468 |
| 757353 | 3818 | 3837 | 145550 | 145569 | GACAGTCTGTTGTGCTGCTG | 67 | 469 |
| 757354 | 3824 | 3843 | 145556 | 145575 | CGTAAAGACAGTCTGTTGTG | 61 | 470 |
| 757355 | 3858 | 3877 | 145590 | 145609 | TGGTATACGCCGGCTGAACG | 57 | 471 |
| 757356 | 3864 | 3883 | 145596 | 145615 | GTGGGTTGGTATACGCCGGC | 75 | 472 |
| 757357 | 3903 | 3922 | 147818 | 147837 | CTGACTGTACATGAGCCTGA | 77 | 473 |
| 757358 | 3909 | 3928 | 147824 | 147843 | CCATTCCTGACTGTACATGA | 53 | 474 |
| 757359 | 3915 | 3934 | 147830 | 147849 | AAGGAACCATTCCTGACTGT | 63 | 475 |
| 757360 | 3921 | 3940 | 147836 | 147855 | GATGAGAAGGAACCATTCCT | 64 | 476 |
| 757361 | 3927 | 3946 | 147842 | 147861 | CAGTTGGATGAGAAGGAACC | 77 | 477 |
| 757362 | 3933 | 3952 | 147848 | 147867 | CATGGGCAGTTGGATGAGAA | 71 | 478 |
| 757363 | 3939 | 3958 | 147854 | 147873 | TTGGCGCATGGGCAGTTGGA | 75 | 479 |
| 757364 | 3945 | 3964 | 147860 | 147879 | GCATCATTGGCGCATGGGCA | 39 | 480 |
| 757365 | 3971 | 3990 | 147886 | 147905 | ACCGCCGGGTGGCTGTGTCG | 79 | 481 |
| 757366 | 3993 | 4012 | 147908 | 147927 | TTTGAGCGAGGGCGGCCTGG | 105 | 482 |
| 757367 | 3999 | 4018 | 147914 | 147933 | GTGCACTTTGAGCGAGGGCG | 80 | 483 |
| 757368 | 4011 | 4030 | 147926 | 147945 | GAATGGGCTGTAGTGCACTT | 44 | 484 |
| 757369 | 4017 | 4036 | 147932 | 147951 | AGACTGGAATGGGCTGTAGT | 67 | 485 |
| 757370 | 4023 | 4042 | 147938 | 147957 | TTGTCGAGACTGGAATGGGC | 61 | 486 |
| 757371 | 4029 | 4048 | 147944 | 147963 | GCGCTGTTGTCGAGACTGGA | 42 | 487 |
| 757372 | 4035 | 4054 | 147950 | 147969 | GGAAATGCGCTGTTGTCGAG | 35 | 488 |
| 757373 | 4064 | 4083 | N/A | N/A | GGCTTGTACTGAAGGGTGCG | 90 | 489 |
| 757374 | 4070 | 4089 | N/A | N/A | GTGGTGGGCTTGTACTGAAG | 69 | 490 |
| 757375 | 4076 | 4095 | 148827 | 148846 | CTGTTGGTGGTGGGCTTGTA | 90 | 491 |
| 757376 | 4082 | 4101 | 148833 | 148852 | CAACTGCTGTTGGTGGTGGG | 79 | 492 |

Example 2: Effect of 5-10-5 MOE Gapmers with Mixed Internucleoside Linkages on Human ATXN2 RNA Expression In Vitro, Single Dose Modified oligonucleotides complementary to a human ATXN2 nucleic acid were designed and tested for their effect on ATXN2 RNA in vitro.

Cultured A431 cells at a density of 10,000 cells per well were transfected via free uptake with 5,000 nM concentration of modified oligonucleotide or no modified oligonucleotide for untreated controls. After approximately 24 hours, RNA was isolated from the cells and ATXN2 RNA levels were measured by quantitative real-time PCR Human primer probe set RTS5049 (forward sequence CTA- CAGTCCTCAGCAGTTCC, designated herein as SEQ ID NO: 13; reverse sequence GCCATCATTCTAGCATTACCCT, designated herein as SEQ ID NO: 14; probe sequence ATCAGCCCCTTGTTCAGCATGTG, designated herein as SEQ ID: 15) was used to measure RNA levels. ATXN2 RNA levels were adjusted according to total RNA content, as measured by RIBOGREEN®. Results are presented in the tables below as percent control ATXN2 RNA levels relative to untreated control cells.

The modified oligonucleotides in the tables below are 5-10-5 MOE gapmers. The gapmers are 20 nucleobases in length, wherein the central gap segment comprises ten 2'-deoxynucleosides and is flanked by wing segments on both the 5' end and on the 3' end comprising five 2'-MOE nucleosides. The sugar motif for the gapmers is (from 5' to 3'): eeeeedddddddddddeeeee; wherein 'd' represents a 2'-deoxyribose sugar and 'e' represents a 2'-MOE modified sugar. The internucleoside linkages are mixed phosphodiester and phosphorothioate linkages. The internucleoside linkage motif for the gapmers is (from 5' to 3'): soooosssssssssssooss; wherein 'o' represents a phosphodiester internucleoside linkage and 's' represents a phosphorothioate internucleoside linkage. Each cytosine residue is a 5-methyl cytosine. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in the tables below is complementary to human ATXN2 nucleic acid sequences SEQ ID NO: 1 or SEQ ID NO: 2, as indicated. 'N/A' indicates that the modified oligonucleotide is not complementary to that particular nucleic acid with 100% complementarity. As shown below, modified oligonucleotides complementary to the nucleobase sequence of human ATXN2 RNA reduced the amount of human ATXN2 RNA.

TABLE 8

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 708199 | GCTAACTGGTTTGCCCTTGC | 29 | 32 |
| 874154 | 5 | 24 | 1995 | 874154 | GCGCTGGGTTGCTTTCTCGG | 104 | 493 |
| 874178 | 246 | 265 | 2236 | 874178 | CCGGCCGCTGGAGCGAGCGC | 85 | 494 |
| 874202 | 469 | 488 | 2459 | 874202 | AGAAGGAGGACGACGAAGGG | 89 | 495 |
| 874224 | 1305 | 1324 | 76442 | 874224 | AAGCCTCAAGTTCCTCATTG | 110 | 496 |
| 874247 | 1561 | 1580 | 81721 | 874247 | GCTGTGTATTTTTCTTCCTC | 24 | 497 |
| 874271 | 2358 | 2377 | 91242 | 874271 | CTCTGTTCGATGCAGGACTA | 86 | 498 |
| 874295 | 2672 | 2691 | 112981 | 874295 | AGAATCCTTAGCACTTGGTT | 45 | 499 |
| 874319 | 3127 | 3146 | 116363 | 874319 | TTGGCTTGATTCACTGGCAT | 89 | 500 |
| 874341 | 4116 | 4135 | 148867 | 874341 | AATTTGGCCTTTCGGTTCCT | 64 | 501 |
| 874365 | 4272 | 4291 | 149023 | 874365 | TGCCTCTACTCGGTCCAAGT | 74 | 502 |
| 874389 | 4422 | 4441 | 149173 | 874389 | TCTTGTTACTTCTTTTGCTA | 63 | 503 |
| 874412 | 4603 | 4622 | 149354 | 874412 | CTTAACTTAAAAGTTGAACC | 118 | 504 |
| 874436 | N/A | N/A | 146563 | 874436 | TCTAGCCCACACCTTGCCAG | 114 | 505 |
| 874484 | N/A | N/A | 3698 | 874484 | CGAACAGCAATGCGGATCGG | 97 | 506 |
| 874508 | N/A | N/A | 5223 | 874508 | GAATTTCCAGACTTTCAAGC | 48 | 507 |
| 874532 | N/A | N/A | 7785 | 874532 | TAACAAAGGATGATGCCATT | 67 | 508 |
| 874556 | N/A | N/A | 9958 | 874556 | TTGGGCAAGTCCCCTAATCT | 115 | 509 |
| 874580 | N/A | N/A | 13708 | 874580 | ACCAGCATGTTAGGAGGCCT | 95 | 510 |
| 874604 | N/A | N/A | 16563 | 874604 | TACTTCTTTGGGAGATATAA | 83 | 511 |
| 874628 | N/A | N/A | 18790 | 874628 | CAGGGTTTCCCCATGTTAGG | 98 | 512 |
| 874652 | N/A | N/A | 20571 | 874652 | AAGGAGCCAAGATTGCCCCA | 116 | 513 |
| 874676 | N/A | N/A | 25034 | 874676 | ACTGAGACTGTAGATGAGCC | 121 | 514 |
| 874700 | N/A | N/A | 28108 | 874700 | AAGCAATGGAACAGTTATTA | 46 | 515 |
| 874724 | N/A | N/A | 30929 | 874724 | CAGTCCCCTCCCAGTGCTAC | 78 | 516 |

TABLE 8-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 874748 | N/A | N/A | 32488 | 874748 | GTTCAAATTCCGGCTCCATC | 32 | 517 |
| 874772 | N/A | N/A | 34639 | 874772 | TGTGGTAAAAAAGCAAGAGA | 70 | 518 |
| 874796 | N/A | N/A | 37016 | 874796 | AAATCAAGCAGAGCCAGGTG | 97 | 519 |
| 874820 | N/A | N/A | 38400 | 874820 | TCTTGGACAGAGGGAGTAAA | 93 | 520 |
| 874844 | N/A | N/A | 41510 | 874844 | AAAGCTCCACGGAAAACAAT | 108 | 521 |
| 874868 | N/A | N/A | 43617 | 874868 | TACATCTTTGACTAATAAAA | 95 | 522 |
| 874892 | N/A | N/A | 44608 | 874892 | ATTATAGAATATAATACAAC | 98 | 523 |
| 874916 | N/A | N/A | 46490 | 874916 | AAAAGCACATTAATTCAAAA | 89 | 524 |
| 874940 | N/A | N/A | 48167 | 874940 | TGTAAATTGTCATACTGTAT | 50 | 525 |
| 874964 | N/A | N/A | 50706 | 874964 | CTACAATTTACAACAGAATT | 79 | 526 |
| 874988 | N/A | N/A | 52791 | 874988 | GATTATAGACATGTGCCATC | 88 | 527 |
| 875012 | N/A | N/A | 55320 | 875012 | TTCTGTAAAGAGACAGTCAA | 100 | 528 |
| 875036 | N/A | N/A | 57881 | 875036 | AAACTGTGAACACCATGAAA | 102 | 529 |
| 875060 | N/A | N/A | 60512 | 875060 | GTTTTGTTTAATCACAGTTT | 32 | 530 |
| 875084 | N/A | N/A | 62556 | 875084 | CATTTTCTCCATTAGGCTTC | 84 | 531 |
| 875108 | N/A | N/A | 64420 | 875108 | AAAGAAAGAAGTACTAATAC | 108 | 532 |
| 875132 | N/A | N/A | 67160 | 875132 | ATATACTAGACACCATGGTT | 78 | 533 |
| 875156 | N/A | N/A | 69694 | 875156 | CTGTTGGCATAGTAACATAC | 74 | 534 |
| 875180 | N/A | N/A | 71679 | 875180 | TAACCATTTCTTCTCAACTA | 116 | 535 |
| 875204 | N/A | N/A | 73162 | 875204 | GTTGTGTTAAGAGGGCATTA | 86 | 536 |
| 875228 | N/A | N/A | 74868 | 875228 | TTTTGTTTTTAACTTTCCAT | 107 | 537 |
| 875252 | N/A | N/A | 77333 | 875252 | GATATGTTACAAATTCTCTT | 40 | 538 |
| 875276 | N/A | N/A | 79712 | 875276 | CTAATGTTTCAACTCCTTTT | 73 | 539 |
| 875300 | N/A | N/A | 81860 | 875300 | AAAGGAAGAGGAAATATAAT | 104 | 540 |
| 875324 | N/A | N/A | 83038 | 875324 | GTCCCTTCCCTTAGATTCTG | 49 | 541 |
| 875348 | N/A | N/A | 84816 | 875348 | CTGGTTCCTTACAATTATCT | 25 | 542 |
| 875372 | N/A | N/A | 86229 | 875372 | TTTGATATGTGGCAATGATG | 54 | 543 |
| 875396 | N/A | N/A | 89279 | 875396 | AACAAAGCACTAAGGACTGA | 73 | 544 |
| 875420 | N/A | N/A | 91499 | 875420 | ACCAATAATTTTATTTATGT | 107 | 545 |
| 875444 | N/A | N/A | 93243 | 875444 | TTGTATGTGTTAACTATTGT | 56 | 546 |
| 875468 | N/A | N/A | 96231 | 875468 | CAGAACAGGAGAAAACATTT | 101 | 547 |
| 875492 | N/A | N/A | 98219 | 875492 | GTTAGACAAGATTTAACATA | 70 | 548 |
| 875516 | N/A | N/A | 99997 | 875516 | GGTATTTATGTGGGCACACT | 65 | 549 |
| 875540 | N/A | N/A | 102876 | 875540 | AAATGAACAAAACGGGAGGA | 122 | 550 |
| 875564 | N/A | N/A | 106246 | 875564 | AACAATATTCCATGCAAATG | 123 | 551 |
| 875588 | N/A | N/A | 109670 | 875588 | ACTGAAAGTAAAGACCCAGT | 111 | 552 |

TABLE 8-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 875612 | N/A | N/A | 111907 | 875612 | GTGATACCCTGTCTCATTTA | 68 | 553 |
| 875636 | N/A | N/A | 113969 | 875636 | CAACTCCTAACCTCAAGTAA | 98 | 554 |
| 875660 | N/A | N/A | 116228 | 875660 | CTAGGCATGAGAAGGTTTCC | 114 | 555 |
| 875684 | N/A | N/A | 119113 | 875684 | GTTAGAATGTGACTCTCCCA | 50 | 556 |
| 875708 | N/A | N/A | 121999 | 875708 | CTGGGACGGCTTTGAATGTG | 76 | 557 |
| 875732 | N/A | N/A | 125533 | 875732 | CAAATTTTTAAATTGTTTTG | 111 | 558 |
| 875756 | N/A | N/A | 128616 | 875756 | TGAGGCTGACACAGGCAGAC | 103 | 559 |
| 875780 | N/A | N/A | 130619 | 875780 | CTTGATCAAGTCCCTGTAAC | 72 | 560 |
| 875804 | N/A | N/A | 132522 | 875804 | ATGTAGTTACATGTAACCAT | 37 | 561 |
| 875828 | N/A | N/A | 134584 | 875828 | GCAGATTTAATGAAGAACAT | 109 | 562 |
| 875852 | N/A | N/A | 137143 | 875852 | TCCATTTTAAAAACTGAATT | 86 | 563 |
| 875876 | N/A | N/A | 139105 | 875876 | AATAAAAGGCAACTTGACCA | 75 | 564 |
| 875900 | N/A | N/A | 141644 | 875900 | ACTGCACCCGGCCTAAAAAT | 101 | 565 |
| 875924 | N/A | N/A | 143719 | 875924 | ATCTCCCATCTTTGCTTTAT | 85 | 566 |
| 875948 | N/A | N/A | 145875 | 875948 | CATTCCAGAGTCAAAGATAT | 99 | 567 |
| 875972 | N/A | N/A | 147334 | 875972 | CACAGTCAAGTATGTGAATT | 96 | 568 |

TABLE 9

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 58 | 32 |
| 874155 | 10 | 29 | 2000 | 2019 | GCGGCGCGCTGGGTTGCTTT | 90 | 569 |
| 874179 | 251 | 270 | 2241 | 2260 | CCGCGCCGGCCGCTGGAGCG | 134 | 570 |
| 874203 | 511 | 530 | 2501 | 2520 | CGGGTTGGCGCGGCCGGAGG | 118 | 571 |
| 874225 | 1317 | 1336 | 76454 | 76473 | CGTCATTTTCCAAAGCCTCA | 60 | 572 |
| 874248 | 1585 | 1604 | 81745 | 81764 | CGTTCACTGGAATTTCTCTG | 61 | 573 |
| 874272 | 2360 | 2379 | 91244 | 91263 | AGCTCTGTTCGATGCAGGAC | 54 | 574 |
| 874296 | 2674 | 2693 | 112983 | 113002 | AAAGAATCCTTAGCACTTGG | 75 | 575 |
| 874320 | 3129 | 3148 | 116365 | 116384 | TCTTGGCTTGATTCACTGGC | 90 | 576 |
| 874342 | 4121 | 4140 | 148872 | 148891 | GAGGGAATTTGGCCTTTCGG | 97 | 577 |
| 874366 | 4277 | 4296 | 149028 | 149047 | CTAAATGCCTCTACTCGGTC | 68 | 578 |
| 874390 | 4440 | 4459 | 149191 | 149210 | AATAGCAGCAAGAATCACTC | 84 | 579 |
| 874413 | 4608 | 4627 | 149359 | 149378 | TTTCCCTTAACTTAAAAGTT | 81 | 580 |

TABLE 9-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 874437 | N/A | N/A | 146568 | 146587 | GCATCTCTAGCCCACACCTT | 82 | 581 |
| 874461 | N/A | N/A | 3425 | 3444 | GGGAGAGAGCCCCGACAGAC | 114 | 582 |
| 874485 | N/A | N/A | 3703 | 3722 | GGCCTCGAACAGCAATGCGG | 84 | 583 |
| 874509 | N/A | N/A | 5239 | 5258 | TTCTTAAAGCAGATGTGAAT | 103 | 584 |
| 874533 | N/A | N/A | 7805 | 7824 | TCAATGTGCACATAAAAGAA | 113 | 585 |
| 874557 | N/A | N/A | 9975 | 9994 | ATCCTACAAATATTGCTTTG | 88 | 586 |
| 874581 | N/A | N/A | 13824 | 13843 | TTACAAAGACTTCATTATAG | 84 | 587 |
| 874605 | N/A | N/A | 16684 | 16703 | TTTCAATAATGCAATGCATC | 96 | 588 |
| 874629 | N/A | N/A | 18946 | 18965 | GTCGCCCAGCAGGCTGGAGT | 108 | 589 |
| 874653 | N/A | N/A | 20901 | 20920 | GAAAAAATAAAAAGGAGAGA | 92 | 590 |
| 874677 | N/A | N/A | 25039 | 25058 | GAGTCACTGAGACTGTAGAT | 98 | 591 |
| 874701 | N/A | N/A | 28112 | 28131 | TTAGAAGCAATGGAACAGTT | 95 | 592 |
| 874725 | N/A | N/A | 30931 | 30950 | GGCAGTCCCCTCCCAGTGCT | 73 | 593 |
| 874749 | N/A | N/A | 32518 | 32537 | CAAGAACTAATATCAGCATT | 71 | 594 |
| 874773 | N/A | N/A | 34663 | 34682 | TTCAGTAGAGCAAGTAACTG | 89 | 595 |
| 874797 | N/A | N/A | 37036 | 37055 | AACAGCAATACAACAATTAA | 102 | 596 |
| 874821 | N/A | N/A | 38419 | 38438 | GTAACAATCCTGGATTGGTT | 87 | 597 |
| 874845 | N/A | N/A | 41559 | 41578 | CAAAGAAGCGCAAATTTGAT | 117 | 598 |
| 874869 | N/A | N/A | 43662 | 43681 | TCCCCTTTAAATAAGTCACA | 103 | 599 |
| 874893 | N/A | N/A | 44669 | 44688 | AGAAAAGATGCAGTACACAA | 91 | 600 |
| 874917 | N/A | N/A | 46497 | 46516 | GCAGAAAAAAAGCACATTAA | 89 | 601 |
| 874941 | N/A | N/A | 48294 | 48313 | CGAATTACATAATACTTAAG | 87 | 602 |
| 874965 | N/A | N/A | 50719 | 50738 | AAATTGTACTGAACTACAAT | 92 | 603 |
| 874989 | N/A | N/A | 52916 | 52935 | GAAAATAAAGCACAAATTCT | 108 | 604 |
| 875013 | N/A | N/A | 55467 | 55486 | AATCAAAGCATGCAATTAGT | 84 | 605 |
| 875037 | N/A | N/A | 57947 | 57966 | GCTTTGCTATCTCTAACTCT | 94 | 606 |
| 875061 | N/A | N/A | 60556 | 60575 | AATTAAACAAATTCACAGAT | 127 | 607 |
| 875085 | N/A | N/A | 62584 | 62603 | TACTGTTTATGGGTGAACAT | 81 | 608 |
| 875109 | N/A | N/A | 64468 | 64487 | AAATGTAGTGTACCTGTGTA | 110 | 609 |
| 875133 | N/A | N/A | 67289 | 67308 | ATCACCACACTCCAACCTCA | 122 | 610 |
| 875157 | N/A | N/A | 69719 | 69738 | TGCAGTTATCAAAAACTAAA | 116 | 611 |
| 875181 | N/A | N/A | 71692 | 71711 | CAAAATCCTCAGCTAACCAT | 128 | 612 |
| 875205 | N/A | N/A | 73171 | 73190 | AGAATTTAGGTTGTGTTAAG | 93 | 613 |
| 875229 | N/A | N/A | 75201 | 75220 | CAGACCGGAGTGCAGTGACA | 108 | 614 |
| 875253 | N/A | N/A | 77463 | 77482 | GAATTAATGACATGTTGCCT | 94 | 615 |
| 875277 | N/A | N/A | 79953 | 79972 | GTAACTCCACAATTCTACGA | 110 | 616 |

TABLE 9-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 875301 | N/A | N/A | 81905 | 81924 | AGATCTTAAACCAATTCTAC | 110 | 617 |
| 875325 | N/A | N/A | 83430 | 83449 | TGATATTGACAAGTCTGGTC | 56 | 618 |
| 875349 | N/A | N/A | 84836 | 84855 | ATTATATCCAATTAGAAATG | 98 | 619 |
| 875373 | N/A | N/A | 86281 | 86300 | ATATGGGTGGCATTTAAATT | 111 | 620 |
| 875397 | N/A | N/A | 89309 | 89328 | TTGTAAGCTCTTGCTTACCA | 95 | 621 |
| 875421 | N/A | N/A | 91828 | 91847 | GTATGGGCATGAAATTAGAC | 66 | 622 |
| 875445 | N/A | N/A | 93318 | 93337 | TTAACTGTGTTAGAATGCTT | 36 | 623 |
| 875469 | N/A | N/A | 96243 | 96262 | AAAGACAACCAACAGAACAG | 76 | 624 |
| 875493 | N/A | N/A | 98273 | 98292 | CAAGCTGCCTAATATACACA | 100 | 625 |
| 875517 | N/A | N/A | 100105 | 100124 | GCTCTTGGTGTCATGGCAAA | 101 | 626 |
| 875541 | N/A | N/A | 102894 | 102913 | CAAAAGCCATACTGAGCAAA | 96 | 627 |
| 875565 | N/A | N/A | 106257 | 106276 | AAGAGCTGGAAAACAATATT | 97 | 628 |
| 875589 | N/A | N/A | 109713 | 109732 | CAGCATTTCTAGACACACCC | 88 | 629 |
| 875613 | N/A | N/A | 112340 | 112359 | CACATAAAACAATAGCACCA | 85 | 630 |
| 875637 | N/A | N/A | 114253 | 114272 | AAAGACAGTAGCTACTTATG | 73 | 631 |
| 875661 | N/A | N/A | 116230 | 116249 | AGCTAGGCATGAGAAGGTTT | 77 | 632 |
| 875685 | N/A | N/A | 119136 | 119155 | TTAAAAAGACAGTACCTCCT | 100 | 633 |
| 875709 | N/A | N/A | 122055 | 122074 | TACACTGTTTAGGACACACA | 78 | 634 |
| 875733 | N/A | N/A | 125689 | 125708 | CACACACTTTAAATACAGGG | 47 | 635 |
| 875757 | N/A | N/A | 128698 | 128717 | TCATTTCTTCTCAAGTTAAT | 100 | 636 |
| 875781 | N/A | N/A | 130627 | 130646 | CCCTCAGACTTGATCAAGTC | 119 | 637 |
| 875805 | N/A | N/A | 132529 | 132548 | AATGCCCATGTAGTTACATG | 54 | 638 |
| 875829 | N/A | N/A | 134590 | 134609 | ATCACTGCAGATTTAATGAA | 94 | 639 |
| 875853 | N/A | N/A | 137205 | 137224 | AAAAATTGATTTCTGAAACA | 108 | 640 |
| 875877 | N/A | N/A | 139231 | 139250 | GCACAAGTCATAAGAGATCA | 45 | 641 |
| 875901 | N/A | N/A | 141780 | 141799 | GGGATTACCTGGCTAATTTT | 75 | 642 |
| 875925 | N/A | N/A | 143835 | 143854 | TATGGTATGTGGCAAGGCCA | 103 | 643 |
| 875949 | N/A | N/A | 145895 | 145914 | AGGAAAGAAGGACTGGGTTG | 112 | 644 |
| 875973 | N/A | N/A | 147394 | 147413 | TTTTGCAGATAACATCCCTT | 68 | 645 |

Example 3: Effect of 5-10-5 MOE Gapmers with Mixed Internucleoside Linkages on Human ATXN2 RNA Expression In Vitro, Single Dose Modified oligonucleotides complementary to a human ATXN2 nucleic acid were designed and tested for their effect on ATXN2 RNA in vitro.

Cultured A431 cells at a density of 10,000 cells per well were transfected using electroporation with 6,000 nM concentration of modified oligonucleotide or no modified oligonucleotide for untreated controls. After approximately 24 hours, RNA was isolated from the cells and ATXN2 RNA levels were measured by quantitative real-time PCR as described in Example 2. Results are presented in the tables below as percent ATXN2 RNA levels relative to untreated control cells. The modified oligonucleotides marked with an asterisk (*) target the amplicon region of the primer probe set. Additional assays may be used to measure the potency and efficacy of oligonucleotides targeting the amplicon region.

The modified oligonucleotides in the tables below are 5-10-5 MOE gapmers. The gapmers are 20 nucleobases in length, wherein the central gap segment comprises ten 2'-deoxynucleosides and is flanked by wing segments on both the 5' end and on the 3' end comprising five 2'-MOE nucleosides. The sugar motif for the gapmers is (from 5' to 3'): eeeeedddddddddddeeeee; wherein 'd' represents a 2'-deoxyribose sugar and 'e' represents a 2'-MOE modified sugar. The internucleoside linkages are mixed phosphodiester and phosphorothioate linkages. The internucleoside linkage motif for the gapmers is (from 5' to 3'): sooooossssssssssooss; wherein 'o' represents a phosphodiester internucleoside linkage and 's' represents a phosphorothioate internucleoside linkage. Each cytosine residue is a 5-methyl cytosine. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in the tables below is complementary to human ATXN2 nucleic acid sequences SEQ ID NO: 1 or SEQ ID NO: 2, as indicated. 'N/A' indicates that the modified oligonucleotide is not complementary to that particular nucleic acid with 100% complementarity. As shown below, modified oligonucleotides complementary to the nucleobase sequence of human ATXN2 reduced the amount of human ATXN2 RNA.

TABLE 10

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 28 | 32 |
| 874156 | 18 | 37 | 2008 | 2027 | AGGAGCGGGCGGCGCGCTGG | 94 | 646 |
| 874180 | 256 | 275 | 2246 | 2265 | CTCCGCCGCGCCGGCCGCTG | 91 | 647 |
| 874204 | 516 | 535 | 2506 | 2525 | AGGCGCGGGTTGGCGCGGCC | 132 | 648 |
| 874226 | 1385 | 1404 | 80740 | 80759 | CGTAGACACTACACCATAAT | 52 | 649 |
| 874249 | 1646 | 1665 | 83257 | 83276 | TCTATTTCTTTGTCCAGGAG | 20 | 650 |
| 874273 | 2361 | 2380 | 91245 | 91264 | CAGCTCTGTTCGATGCAGGA | 36 | 651 |
| 874297 | 2675 | 2694 | 112984 | 113003 | GAAAGAATCCTTAGCACTTG | 41 | 652 |
| 874321 | 3130 | 3149 | 116366 | 116385 | GTCTTGGCTTGATTCACTGG | 49 | 653 |
| 874343 | 4137 | 4156 | 148888 | 148907 | AAGCAGTAGAAGGGAGGAGG | 93 | 654 |
| 874367 | 4282 | 4301 | 149033 | 149052 | AGTTCCTAAATGCCTCTACT | 49 | 655 |
| 874391 | 4445 | 4464 | 149196 | 149215 | GCAGTAATAGCAGCAAGAAT | 93 | 656 |
| 874414 | 4613 | 4632 | 149364 | 149383 | AAGTTTTTCCCTTAACTTAA | 73 | 657 |
| 874438 | N/A | N/A | 146573 | 146592 | GAGTCGCATCTCTAGCCCAC | 58 | 658 |
| 874462 | N/A | N/A | 3475 | 3494 | CACTTGTCTCCACCCCGTCC | 100 | 659 |
| 874486 | N/A | N/A | 3714 | 3733 | TTCTCCACTGCGGCCTCGAA | 45 | 660 |
| 874510 | N/A | N/A | 5251 | 5270 | ATTATGAAATGTTTCTTAAA | 73 | 661 |
| 874534 | N/A | N/A | 7835 | 7854 | TTTTTGGTCTAACTTCAGAG | 44 | 662 |
| 874558 | N/A | N/A | 9990 | 10009 | GAGAGGTGTAATAAAATCCT | 53 | 663 |
| 874582 | N/A | N/A | 13950 | 13969 | TGTTCAATAAAGCCTCTCAA | 65 | 664 |
| 874606 | N/A | N/A | 16689 | 16708 | AATTATTTCAATAATGCAAT | 88 | 665 |
| 874630 | N/A | N/A | 19022 | 19041 | AACAGAAAATATTAAGACTT | 133 | 666 |
| 874654 | N/A | N/A | 21088 | 21107 | CAGCTACTAAGGAGGCAGAA | 104 | 667 |
| 874678 | N/A | N/A | 25040 | 25059 | TGAGTCACTGAGACTGTAGA | 125 | 668 |
| 874702 | N/A | N/A | 28494 | 28513 | CCGGATTGTTTTCTTCATTA | 15 | 669 |
| 874726 | N/A | N/A | 30965 | 30984 | ATTTTGAAGCCCTTTTTCTT | 86 | 670 |
| 874750 | N/A | N/A | 32534 | 32553 | ACAATTACCATTCACACAAG | 108 | 671 |
| 874774 | N/A | N/A | 34867 | 34886 | CGCCCGCCACCACATCCCCG | 81 | 672 |

TABLE 10-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 874798 | N/A | N/A | 37079 | 37098 | GTTTGCCCATCCTCACACTG | 78 | 673 |
| 874822 | N/A | N/A | 38436 | 38455 | ATACATGATAACCGAAGGTA | 44 | 674 |
| 874846 | N/A | N/A | 41631 | 41650 | GGAAAGAGAGCTGGGAGGAC | 71 | 675 |
| 874870 | N/A | N/A | 43690 | 43709 | AAGCTATATAAAAGACTTAA | 96 | 676 |
| 874894 | N/A | N/A | 44693 | 44712 | CTTTCCTTGCCAACTCTCTC | 138 | 677 |
| 874918 | N/A | N/A | 46532 | 46551 | TAAGACCAGAAAGCCAAAGG | 71 | 678 |
| 874942 | N/A | N/A | 48314 | 48333 | CCAGGACCTCCTTCAGATAC | 59 | 679 |
| 874966 | N/A | N/A | 50832 | 50851 | CTCCTAAGTCTAAGAGAAAG | 84 | 680 |
| 874990 | N/A | N/A | 53025 | 53044 | AACACTCTATCTATCCATTC | 71 | 681 |
| 875014 | N/A | N/A | 55577 | 55596 | TGATTTTTCACTAAATGTGA | 97 | 682 |
| 875038 | N/A | N/A | 58068 | 58087 | CACACCAGCACACCAGGCTA | 100 | 683 |
| 875062 | N/A | N/A | 60580 | 60599 | CTTATAAAGTCCTTCTCCAC | 127 | 684 |
| 875086 | N/A | N/A | 62923 | 62942 | TTTAGAAATGGTATCAGTTA | 69 | 685 |
| 875110 | N/A | N/A | 64474 | 64493 | TAAACAAAATGTAGTGTACC | 104 | 686 |
| 875134 | N/A | N/A | 67636 | 67655 | AAAAAACAGTTATTCCCTGG | 78 | 687 |
| 875158 | N/A | N/A | 69783 | 69802 | ATTCAGAATGTACTTAAATT | 91 | 688 |
| 875182 | N/A | N/A | 71785 | 71804 | TAAAAACTATAAAATGACAT | 94 | 689 |
| 875206 | N/A | N/A | 73172 | 73191 | CAGAATTTAGGTTGTGTTAA | 46 | 690 |
| 875230 | N/A | N/A | 75224 | 75243 | GAGATGGAGCTTGCTCTTTC | 80 | 691 |
| 875254 | N/A | N/A | 77472 | 77491 | AAAGTTTGAGAATTAATGAC | 85 | 692 |
| 875278 | N/A | N/A | 80006 | 80025 | CTCAGAAGTGGCAACTCTGG | 133 | 693 |
| 875302 | N/A | N/A | 81907 | 81926 | ACAGATCTTAAACCAATTCT | 67 | 694 |
| 875326 | N/A | N/A | 83480 | 83499 | TATGTAAACTATTTTAAGTA | 162 | 695 |
| 875350 | N/A | N/A | 84936 | 84955 | GATAATTTCACATAATAAAT | 98 | 696 |
| 875374 | N/A | N/A | 86298 | 86317 | GAAAACAGGTTTTTAATATA | 85 | 697 |
| 875398 | N/A | N/A | 89332 | 89351 | TGTTTGTTTGTTTTAAGTAT | 14 | 698 |
| 875422 | N/A | N/A | 92190 | 92209 | ACTGTATACATAACGCATTT | 80 | 699 |
| 875446 | N/A | N/A | 93885 | 93904 | CGTCTGTGGAGAAAGAAGTA | 102 | 700 |
| 875470 | N/A | N/A | 96308 | 96327 | AAAATCAGATAAATTGGACT | 67 | 701 |
| 875494 | N/A | N/A | 98278 | 98297 | TTGCCCAAGCTGCCTAATAT | 90 | 702 |
| 875518 | N/A | N/A | 100258 | 100277 | TTAGGACAACGGACCTAAGC | 103 | 703 |
| 875542 | N/A | N/A | 102896 | 102915 | AGCAAAAGCCATACTGAGCA | 71 | 704 |
| 875566 | N/A | N/A | 106280 | 106299 | AAATCACACATAGACTAAAA | 89 | 705 |
| 875590 | N/A | N/A | 109774 | 109793 | TCAGCCCCAGTACAATAAAG | 84 | 706 |
| 875614 | N/A | N/A | 112397 | 112416 | TAAGTAAAAGGAAGAGTATG | 98 | 707 |
| 875638 | N/A | N/A | 114258 | 114277 | GCTGAAAAGACAGTAGCTAC | 71 | 708 |

TABLE 10-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 875662 | N/A | N/A | 116237 | 116256 | GCTAGAGAGCTAGGCATGAG | 47 | 709 |
| 875686 | N/A | N/A | 119146 | 119165 | ATCATTTCTATTAAAAAGAC | 90 | 710 |
| 875710 | N/A | N/A | 122060 | 122079 | ATTACTACACTGTTTAGGAC | 55 | 711 |
| 875734 | N/A | N/A | 125791 | 125810 | CACAAAAAGACACTTGTTAT | 86 | 712 |
| 875758 | N/A | N/A | 129116 | 129135 | AAAAAATGTACAAAACCTTA | 99 | 713 |
| 875782 | N/A | N/A | 130691 | 130710 | ATTCTGCTTCATCCTTCAGG | 54 | 714 |
| 875806 | N/A | N/A | 132608 | 132627 | GTTCAGGACATCTAAACTTA | 61 | 715 |
| 875830 | N/A | N/A | 134620 | 134639 | AAGGCTTTGAAAGTCTAATA | 46 | 716 |
| 875854 | N/A | N/A | 137343 137421 | 137362 137440 | ATACCAAGCTTGTGGCTTGG | 128 | 717 |
| 875878 | N/A | N/A | 139233 | 139252 | ATGCACAAGTCATAAGAGAT | 90 | 718 |
| 875902 | N/A | N/A | 142200 | 142219 | TTGTTTAATTTTTGACAGAG | 67 | 719 |
| 875926 | N/A | N/A | 143901 | 143920 | TGGAGCAATGTCCTGAGGGC | 66 | 720 |
| 875950 | N/A | N/A | 145923 | 145942 | ATATAGACATAGCAAAGCAG | 107 | 721 |
| 875974 | N/A | N/A | 147433 | 147452 | ATGCTTCAGAATCAGGCTGC | 64 | 722 |

TABLE 11

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 32 | 32 |
| 874157 | 89 | 108 | 2079 | 2098 | CTTTACCGGAAGTCGGAGGG | 121 | 723 |
| 874181 | 261 | 280 | 2251 | 2270 | GCCCGCTCCGCCGCGCCGGC | 115 | 724 |
| 874205 | 572 | 591 | 2562 | 2581 | CGGGCGCGCCAAGGAGACGC | 95 | 725 |
| 874227 | 1417 | 1436 | N/A | N/A | GGCACTGTATACGAAGATAA | 67 | 726 |
| 874250 | 1648 | 1667 | 83259 | 83278 | TCTCTATTTCTTTGTCCAGG | 20 | 727 |
| 874274 | 2362 | 2381 | 91246 | 91265 | ACAGCTCTGTTCGATGCAGG | 37 | 728 |
| 874298 | 2676 | 2695 | 112985 | 113004 | TGAAAGAATCCTTAGCACTT | 51 | 729 |
| 874322 | 3131 | 3150 | 116367 | 116386 | TGTCTTGGCTTGATTCACTG | 72 | 730 |
| 874344 | 4142 | 4161 | 148893 | 148912 | GGTAGAAGCAGTAGAAGGGA | 45 | 731 |
| 874368 | 4287 | 4306 | 149038 | 149057 | CCCCAAGTTCCTAAATGCCT | 69 | 732 |
| 874392 | 4450 | 4469 | 149201 | 149220 | TTTTAGCAGTAATAGCAGCA | 65 | 733 |
| 874415 | 4618 | 4637 | 149369 | 149388 | AGTAAAGTTTTTCCCTTAA | 35 | 734 |
| 874439 | N/A | N/A | 146578 | 146597 | CAACTGAGTCGCATCTCTAG | 88 | 735 |
| 874463 | N/A | N/A | 3480 | 3499 | AGGCCCACTTGTCTCCACCC | 109 | 736 |

TABLE 11-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 874487 | N/A | N/A | 3719 | 3738 | GCGCCTTCTCCACTGCGGCC | 138 | 737 |
| 874511 | N/A | N/A | 5358 | 5377 | TTATCTTTCCTAAAACAGCC | 62 | 738 |
| 874535 | N/A | N/A | 7849 | 7868 | AATGTCAATTAACTTTTTG | 72 | 739 |
| 874559 | N/A | N/A | 10080 | 10099 | GACAGGAGAAATGCTTGGCC | 134 | 740 |
| 874583 | N/A | N/A | 13962 | 13981 | CATTGGCAACACTGTTCAAT | 66 | 741 |
| 874607 | N/A | N/A | 16692 | 16711 | AACAATTATTTCAATAATGC | 129 | 742 |
| 874631 | N/A | N/A | 19028 | 19047 | CATAAAAACAGAAAATATTA | 86 | 743 |
| 874655 | N/A | N/A | 21122 | 21141 | AAGATGACAACGGAACGGGA | 58 | 744 |
| 874679 | N/A | N/A | 25252 | 25271 | CTGCACGCCACTGTACTCCA | 59 | 745 |
| 874703 | N/A | N/A | 28507 | 28526 | CTGACAATAATCACCGGATT | 32 | 746 |
| 874727 | N/A | N/A | 30982 | 31001 | CCATCTCAACTCTCATTATT | 74 | 747 |
| 874751 | N/A | N/A | 32580 | 32599 | GCCAGATTAATCCGGTCATA | 73 | 748 |
| 874775 | N/A | N/A | 35179 | 35198 | ATTCTGTAAGGCTACTACTG | 60 | 749 |
| 874799 | N/A | N/A | 37218 | 37237 | TGATTTTTATGTTCCTCAAG | 35 | 750 |
| 874823 | N/A | N/A | 38567 | 38586 | ATCTGAATCTAATCATAAGG | 142 | 751 |
| 874847 | N/A | N/A | 41643 | 41662 | GGCCAGAACTAGGGAAAGAG | 69 | 752 |
| 874871 | N/A | N/A | 43726 | 43745 | CACGAACTGTCCTTAAACTC | 64 | 753 |
| 874895 | N/A | N/A | 44805 | 44824 | TCATATGATTACAACTGCAG | 74 | 754 |
| 874919 | N/A | N/A | 46547 | 46566 | TAACATTCCAAAATTTAAGA | 76 | 755 |
| 874943 | N/A | N/A | 48522 | 48541 | ACAATACACTGAACTCTTGA | 69 | 756 |
| 874967 | N/A | N/A | 50878 | 50897 | AATACCCAGTACTGTTAGCC | 81 | 757 |
| 874991 | N/A | N/A | 53104 | 53123 | TGAAATCAATTCATATCTTT | 91 | 758 |
| 875015 | N/A | N/A | 55614 | 55633 | ATGGAGATCTTTTCCATTAA | 88 | 759 |
| 875039 | N/A | N/A | 58233 | 58252 | TACTAAAATCTACACAATTC | 128 | 760 |
| 875063 | N/A | N/A | 60587 | 60606 | AGTCATGCTTATAAAGTCCT | 30 | 761 |
| 875087 | N/A | N/A | 62947 | 62966 | ACTTAAAATTTGAACTGAAA | 119 | 762 |
| 875111 | N/A | N/A | 64571 | 64590 | ACCCGGCCCACACAAAAACT | 96 | 763 |
| 875135 | N/A | N/A | 68028 | 68047 | GGTTCAAGCAAATTGCTTGT | 77 | 764 |
| 875159 | N/A | N/A | 69889 | 69908 | GTATGATGACAAAAGAGGAC | 86 | 765 |
| 875183 | N/A | N/A | 71861 | 71880 | TTTTAAAGGGCCAGAATAAT | 100 | 766 |
| 875207 | N/A | N/A | 73177 | 73196 | CTGACCAGAATTTAGGTTGT | 146 | 767 |
| 875231 | N/A | N/A | 75227 | 75246 | TTTGAGATGGAGCTTGCTCT | 117 | 768 |
| 875255 | N/A | N/A | 77500 | 77519 | CATTATATTAGGTTATATAT | 137 | 769 |
| 875279 | N/A | N/A | 80036 | 80055 | AAATGGTTTTACCATTAGCA | 80 | 770 |
| 875303 | N/A | N/A | 81936 | 81955 | TTTCCAAGATCACCATAACC | 76 | 771 |
| 875327 | N/A | N/A | 83758 | 83777 | TATGTCTAAAAAATTTTATT | 87 | 772 |

TABLE 11-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 875351 | N/A | N/A | 85054 | 85073 | AGGGTTAATTAGGATCTATA | 27 | 773 |
| 875375 | N/A | N/A | 86537 | 86556 | AACTTGCTCTTCAAGGTTAG | 79 | 774 |
| 875399 | N/A | N/A | 89386 | 89405 | TTTTAAAGGTTCTCTGGACT | 56 | 775 |
| 875423 | N/A | N/A | 92208 | 92227 | TATGGTTTGATGTTTCTGAC | 38 | 776 |
| 875447 | N/A | N/A | 95006 | 95025 | CCCTCCCCCTCCTTCTCCTT | 110 | 777 |
| 875471 | N/A | N/A | 96438 | 96457 | AAAGAAAAAAAAGTTGCTC | 90 | 778 |
| 875495 | N/A | N/A | 98289 | 98308 | TTAACTTCTCTTTGCCCAAG | 82 | 779 |
| 875519 | N/A | N/A | 100293 | 100312 | AGTACAAGCAACAAAAACAG | 95 | 780 |
| 875543 | N/A | N/A | 102900 | 102919 | AAAGAGCAAAAGCCATACTG | 93 | 781 |
| 875567 | N/A | N/A | 106296 | 106315 | ACACACTTTACCTATAAAAT | 96 | 782 |
| 875591 | N/A | N/A | 109890 | 109909 | TGTGCCAGCTTCAGATATGA | 72 | 783 |
| 875615 | N/A | N/A | 112404 | 112423 | AATAGTCTAAGTAAAAGGAA | 106 | 784 |
| 875639 | N/A | N/A | 114281 | 114300 | CTGGCCAATCAACAAACACT | 76 | 785 |
| 875663 | N/A | N/A | 116247 | 116266 | GTTTTATATTGCTAGAGAGC | 65 | 786 |
| 875687 | N/A | N/A | 119697 | 119716 | TGCTCCCAGCCTCATATGAA | 109 | 787 |
| 875711 | N/A | N/A | 122603 | 122622 | TTAAAAAAATGAAATATGCA | 83 | 788 |
| 875735 | N/A | N/A | 125807 | 125826 | CAGAAACAAATTCAACCACA | 76 | 789 |
| 875759 | N/A | N/A | 129144 | 129163 | AAAAGAACCTACCTAAGGCA | 121 | 790 |
| 875783* | N/A | N/A | 131147 | 131166 | TATTAAAAGTTTTTTTATAT | 93 | 791 |
| 875807 | N/A | N/A | 132969 | 132988 | CCAGAAATCTGTAAATTCTT | 33 | 792 |
| 875831 | N/A | N/A | 134653 | 134672 | TGTACTTCAAATTTTGTTTA | 28 | 793 |
| 875855 | N/A | N/A | 137344 137422 | 137363 137441 | TATACCAAGCTTGTGGCTTG | 146 | 794 |
| 875879 | N/A | N/A | 139271 | 139290 | GTTTAATTTGTAACTAGGTT | 22 | 795 |
| 875903 | N/A | N/A | 142210 | 142229 | ATGTATTTATTTGTTTAATT | 95 | 796 |
| 875927 | N/A | N/A | 143971 | 143990 | CAAGTGCATTTTAGGTGCAC | 92 | 797 |
| 875951 | N/A | N/A | 145925 | 145944 | CTATATAGACATAGCAAAGC | 80 | 798 |
| 875975 | N/A | N/A | 147453 | 147472 | ATATCATACAAGATTCAATG | 86 | 799 |

TABLE 12

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 (% control) | SEQ ID NO |
|---|---|---|---|---|---|---|---|
| 708199 | 1477 | 1496 | 81637 | 81656 | GCTAACTGGTTTGCCCTTGC | 41 | 32 |
| 874158 | 94 | 113 | 2084 | 2103 | GGACTCTTTACCGGAAGTCG | 92 | 800 |

TABLE 12-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 (% control) | SEQ ID NO |
|---|---|---|---|---|---|---|---|
| 874182 | 266 | 285 | 2256 | 2275 | GCCCCGCCCGCTCCGCCGCG | 55 | 801 |
| 874206 | 577 | 596 | 2567 | 2586 | GGAGCCGGGCGCGCCAAGGA | 114 | 802 |
| 874228 | 1467 | 1486 | 81627 | 81646 | TTGCCCTTGCTTCCCGTTTT | 48 | 803 |
| 874251 | 1649 | 1668 | 83260 | 83279 | TTCTCTATTTCTTTGTCCAG | 39 | 804 |
| 874275 | 2364 | 2383 | 91248 | 91267 | TAACAGCTCTGTTCGATGCA | 53 | 805 |
| 874299 | 2678 | 2697 | 112987 | 113006 | AATGAAAGAATCCTTAGCAC | 65 | 806 |
| 874323 | 3133 | 3152 | 116369 | 116388 | TATGTCTTGGCTTGATTCAC | 73 | 807 |
| 874345 | 4147 | 4166 | 148898 | 148917 | CAGTTGGTAGAAGCAGTAGA | 53 | 808 |
| 874369 | 4292 | 4311 | 149043 | 149062 | ATAGCCCCCAAGTTCCTAAA | 45 | 809 |
| 874393 | 4455 | 4474 | 149206 | 149225 | TTTTTTTTTAGCAGTAATAG | 118 | 810 |
| 874416 | 4623 | 4642 | 149374 | 149393 | TACAAAGTAAAAGTTTTTCC | 132 | 811 |
| 874440 | N/A | N/A | 146583 | 146602 | AGATCCAACTGAGTCGCATC | 62 | 812 |
| 874464 | N/A | N/A | 3512 | 3531 | TCGGACACGAACGCAGAGGG | 46 | 813 |
| 874488 | N/A | N/A | 5403 | 5422 | TTCGACCTCGATGTTCCACA | 85 | 814 |
| 874512 | N/A | N/A | 7908 | 7927 | CAAAATTAGATTACAGTAAA | 96 | 815 |
| 874536 | N/A | N/A | 10350 | 10369 | AACAAAACATGTCTCTTTGG | 100 | 816 |
| 874560 | N/A | N/A | 13986 | 14005 | CAGCATGATCTTGTGTATAT | 23 | 817 |
| 874584 | N/A | N/A | 16725 | 16744 | AAGGAAATTTAAAAAAAAAC | 93 | 818 |
| 874608 | N/A | N/A | 19049 | 19068 | CCTCGGCAACTAAGAGCGAA | 125 | 819 |
| 874632 | N/A | N/A | 21273 | 21292 | TCCCATCTCAAAAAATAAAT | 118 | 820 |
| 874656 | N/A | N/A | 25454 | 25473 | AGGTACTCAGCAAGCTGAGG | 93 | 821 |
| 874680 | N/A | N/A | 28537 | 28556 | GCCACTTTGGAAGGTCGAGG | 63 | 822 |
| 874704 | N/A | N/A | 31297 | 31316 | AAAGCATGGTTGATTGAAGA | 48 | 823 |
| 874728 | N/A | N/A | 32795 | 32814 | CTAAAGCTGAGTGACAGGTA | 46 | 824 |
| 874752 | N/A | N/A | 35188 | 35207 | CTTGTTGTTGTTTACATTAT | 23 | 825 |
| 874776 | N/A | N/A | 37309 | 37328 | AAGAAATACATTCTGTAAGG | 64 | 826 |
| 874800 | N/A | N/A | 38708 | 38727 | AAACTTTCCATTTCAAAGCT | 88 | 827 |
| 874824 | N/A | N/A | 41669 | 41688 | AACTTAGTAGACACAACTCT | 104 | 828 |
| 874848 | N/A | N/A | 43780 | 43799 | GCTAAATTGTAGTTGTCTAG | 57 | 829 |
| 874872 | N/A | N/A | 44818 | 44837 | TCTGGTATCCTGGTGGCTGC | 85 | 830 |
| 874896 | N/A | N/A | 45132 | 45151 | AAAGAAAAACAGGTCATATG | 68 | 831 |
| 874920 | N/A | N/A | 46580 | 46599 | TTCTGCCCTTCATGTCCGGT | 80 | 832 |
| 874944 | N/A | N/A | 48569 | 48588 | ATATTAGGTATTCACTAACA | 66 | 833 |
| 874968 | N/A | N/A | 50978 | 50997 | GGCCTCTTAAGACAAAAAGT | 83 | 834 |
| 874992 | N/A | N/A | 53114 | 53133 | AGCTCAGAAATGAAATCAAT | 71 | 835 |
| 875016 | N/A | N/A | 55889 | 55908 | ACCAGCCTGTGCAATACAGG | 120 | 836 |

TABLE 12-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 (% control) | SEQ ID NO |
|---|---|---|---|---|---|---|---|
| 875040 | N/A | N/A | 58283 | 58302 | TATTTCTCACTGTTCTCTAA | 135 | 837 |
| 875064 | N/A | N/A | 60616 | 60635 | CTTTTACTTCATGATTTTTT | 67 | 838 |
| 875088 | N/A | N/A | 62995 | 63014 | AGTAATTTTATGTTTTTAAA | 101 | 839 |
| 875112 | N/A | N/A | 64881 | 64900 | TCCACACGCAGTTTTTTTTT | 77 | 840 |
| 875136 | N/A | N/A | 68147 | 68166 | TTTCCCATATAATTTTTTTT | 105 | 841 |
| 875160 | N/A | N/A | 69928 | 69947 | CAGGTGGAGCCACGCTCCTC | 95 | 842 |
| 875184 | N/A | N/A | 71978 | 71997 | GGGTATCCCCAGCCCCATAC | 98 | 843 |
| 875208 | N/A | N/A | 73487 | 73506 | TAGAAGCTCAGTATTAAAAA | 72 | 844 |
| 875232 | N/A | N/A | 75614 | 75633 | GTAATTACTCTGCATGTCTC | 60 | 845 |
| 875256 | N/A | N/A | 77522 | 77541 | CGTGATGTACAGACTTGAGA | 50 | 846 |
| 875280 | N/A | N/A | 80042 | 80061 | CTTTAGAAATGGTTTTACCA | 139 | 847 |
| 875304 | N/A | N/A | 82011 | 82030 | GCTCTTCAAGATCTTGGATT | 57 | 848 |
| 875328 | N/A | N/A | 83789 | 83808 | TTGCACATAGGTTAGAATTT | 10 | 849 |
| 875352 | N/A | N/A | 85056 | 85075 | AAAGGGTTAATTAGGATCTA | 43 | 850 |
| 875376 | N/A | N/A | 86832 | 86851 | TCTTTAGAAGAATGCTAATG | 82 | 851 |
| 875400 | N/A | N/A | 89401 | 89420 | GGCCGATCTTGTTTCTTTTA | 107 | 852 |
| 875424 | N/A | N/A | 92295 | 92314 | TATTGTTGTTACCAAATCTC | 63 | 853 |
| 875448 | N/A | N/A | 95058 | 95077 | GGAAGAATACCTACAGCAAG | 75 | 854 |
| 875472 | N/A | N/A | 96869 | 96888 | CTGAGCACCAAGTCACTCTC | 118 | 855 |
| 875496 | N/A | N/A | 98388 | 98407 | TGCACTATGCATTAGTTACT | 73 | 856 |
| 875520 | N/A | N/A | 100334 | 100353 | CAAAAGAAAGAAAACAGGAA | 77 | 857 |
| 875544 | N/A | N/A | 102911 | 102930 | CAAAAGGCCCAAAAGAGCAA | 70 | 858 |
| 875568 | N/A | N/A | 106734 | 106753 | TAACAAAATGGTAGTAGTTA | 144 | 859 |
| 875592 | N/A | N/A | 110018 | 110037 | CTAGACATATTCTGGACCAG | 68 | 860 |
| 875616 | N/A | N/A | 112411 | 112430 | GATGGAGAATAGTCTAAGTA | 76 | 861 |
| 875640 | N/A | N/A | 114357 | 114376 | TGGCCACGCTGACCTTAAGT | 88 | 862 |
| 875664 | N/A | N/A | 116254 | 116273 | ACTCTTAGTTTTATATTGCT | 66 | 863 |
| 875688 | N/A | N/A | 119897 | 119916 | GTTCAAGCGATTCTGATGCT | 51 | 864 |
| 875712 | N/A | N/A | 122950 | 122969 | CTTATTAATTGAAATATGTA | 144 | 865 |
| 875736 | N/A | N/A | 125972 | 125991 | GTTGGTTTTAAAAAGGCAAC | 86 | 866 |
| 875760 | N/A | N/A | 129173 | 129192 | GAGAAGTCCCTGGGTTACAC | 47 | 867 |
| 875784* | N/A | N/A | 131173 | 131192 | AATTATAAAGGAAAATCCCT | 102 | 868 |
| 875808 | N/A | N/A | 133004 | 133023 | TATGAAAAGTAGTAATGTCT | 60 | 869 |
| 875832 | N/A | N/A | 134730 | 134749 | TTATAAAATATAAATTGTTC | 120 | 870 |
| 875856 | N/A | N/A | 137345 137423 | 137364 137442 | TTATACCAAGCTTGTGGCTT | 89 | 871 |

TABLE 12-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 (% control) | SEQ ID NO |
|---|---|---|---|---|---|---|---|
| 875880 | N/A | N/A | 139284 | 139303 | CAGAAAGCTGTGTGTTTAAT | 39 | 872 |
| 875904 | N/A | N/A | 142258 | 142277 | CGAACCTGAGTTTGTTGTAC | 40 | 873 |
| 875928 | N/A | N/A | 144009 | 144028 | AAAAGGCAACTTGAAGGCAT | 73 | 874 |
| 875952 | N/A | N/A | 145950 | 145969 | TGTACACATATATATAGTAG | 65 | 875 |
| 875976 | N/A | N/A | 147460 | 147479 | CAACTTAATATCATACAAGA | 95 | 876 |

TABLE 13

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 31 | 32 |
| 874159 | 99 | 118 | 2089 | 2108 | GATAGGGACTCTTTACCGGA | 109 | 877 |
| 874183 | 271 | 290 | 2261 | 2280 | CCGCCGCCCCGCCCGCTCCG | 118 | 878 |
| 874207 | 752 | 771 | 2742 | 2761 | GCCGCTGCCGCCGGGCTTGC | 157 | 879 |
| 874229 | 1469 | 1488 | 81629 | 81648 | GTTTGCCCTTGCTTCCCGTT | 30 | 880 |
| 874252 | 1650 | 1669 | 83261 | 83280 | CTTCTCTATTTCTTTGTCCA | 44 | 881 |
| 874276 | 2365 | 2384 | 91249 | 91268 | GTAACAGCTCTGTTCGATGC | 34 | 882 |
| 874300 | 2758 | 2777 | 113067 | 113086 | GTGTTACTAAGTATTGAAGG | 32 | 883 |
| 874324* | 3388 | 3407 | 131469 | 131488 | TGTGTTGGTGGTGCCATCAT | 254 | 884 |
| 874346 | 4152 | 4171 | 148903 | 148922 | GCTTCCAGTTGGTAGAAGCA | 115 | 885 |
| 874370 | 4297 | 4316 | 149048 | 149067 | ATGGAATAGCCCCCAAGTTC | 57 | 886 |
| 874394 | 4476 | 4495 | 149227 | 149246 | AAGTCTTGATTTTTTTTTTT | 106 | 887 |
| 874417 | 4628 | 4647 | 149379 | 149398 | TTATCTACAAAGTAAAAGTT | 77 | 888 |
| 874441 | N/A | N/A | 146588 | 146607 | GAGATAGATCCAACTGAGTC | 60 | 889 |
| 874465 | N/A | N/A | 3517 | 3536 | CCGCCTCGGACACGAACGCA | 81 | 890 |
| 874489 | N/A | N/A | N/A | N/A | ACTGTTTCGACCTCGATGTT | 121 | 891 |
| 874513 | N/A | N/A | 5527 | 5546 | ATGAACCCAGGAGACAGAGA | 62 | 892 |
| 874537 | N/A | N/A | 7982 | 8001 | AAAAAGTTTATTTTCTCCAC | 53 | 893 |
| 874561 | N/A | N/A | 10665 | 10684 | GGTTTCATGCCATTCTCTTG | 66 | 894 |
| 874585 | N/A | N/A | 14245 | 14264 | TAATTAAAGCACTTTGGGAA | 71 | 895 |
| 874609 | N/A | N/A | 17106 | 17125 | ATTCTTGGCAGCTGGGTGCA | 60 | 896 |
| 874633 | N/A | N/A | 19342 | 19361 | ATGATGGCACACACATGTGG | 74 | 897 |
| 874657 | N/A | N/A | 21336 | 21355 | CTCCGAAAAATTAAAAATAA | 82 | 898 |
| 874681 | N/A | N/A | 25995 | 26014 | TTATTCACTACTGTATTCCC | 51 | 899 |
| 874705 | N/A | N/A | 28864 | 28883 | CCAGACTTTGCAGCCTACCA | 65 | 900 |

TABLE 13-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 874729 | N/A | N/A | 31541 | 31560 | TTCCCATCTTCTCGAGTTCT | 78 | 901 |
| 874753 | N/A | N/A | 32803 | 32822 | TCAGACTTCTTGTTGTTGTT | 19 | 902 |
| 874777 | N/A | N/A | 35267 | 35286 | GAGATAGCATGCCACTGCAC | 51 | 903 |
| 874801 | N/A | N/A | 37352 | 37371 | AACAGCCCAATCAGAACAAG | 58 | 904 |
| 874825 | N/A | N/A | 38727 | 38746 | AATAACTTTATAGTGAAGAA | 71 | 905 |
| 874849 | N/A | N/A | 41776 | 41795 | AAAAACTCACAATCTCTTCC | 68 | 906 |
| 874873 | N/A | N/A | 43784 | 43803 | ATGATCTGGTATCCTGGTGG | 39 | 907 |
| 874897 | N/A | N/A | 45158 | 45177 | CTTCCCATATTTCTCCCCCA | 77 | 908 |
| 874921 | N/A | N/A | 46603 | 46622 | TTCCATCATGTGGGACTTAT | 51 | 909 |
| 874945 | N/A | N/A | 48588 | 48607 | CCTCATCAGGCTTCATTCAA | 72 | 910 |
| 874969 | N/A | N/A | 51035 | 51054 | ATCAACTCCAAAGGTAGCAG | 26 | 911 |
| 874993 | N/A | N/A | 53450 | 53469 | AACAAACAAACATTAATTCG | 85 | 912 |
| 875017 | N/A | N/A | 56035 | 56054 | AGTCAAGGGCATGATTGAAG | 63 | 913 |
| 875041 | N/A | N/A | 58308 | 58327 | CAGAATAAAACAATCTGTAG | 97 | 914 |
| 875065 | N/A | N/A | 60652 | 60671 | TAAATCTTTAATCTCTTTAT | 60 | 915 |
| 875089 | N/A | N/A | 63006 | 63025 | TGTACCCAGCCAGTAATTTT | 67 | 916 |
| 875113 | N/A | N/A | 65073 | 65092 | AAATCAGCCTGTGCAACAGT | 106 | 917 |
| 875137 | N/A | N/A | 68347 | 68366 | CCCTAGGGATACCAAAATCC | 111 | 918 |
| 875161 | N/A | N/A | 69938 | 69957 | ACCAAGGGCACAGGTGGAGC | 73 | 919 |
| 875185 | N/A | N/A | 72025 | 72044 | GCTGGTGGTCATAAAGAAAT | 128 | 920 |
| 875209 | N/A | N/A | 73728 | 73747 | TTTCAAGAATGTAAAATGTT | 92 | 921 |
| 875233 | N/A | N/A | 75640 | 75659 | ACATAATTCATTAAATTATA | 122 | 922 |
| 875257 | N/A | N/A | 77573 | 77592 | ACCAATAGTGTAAAAGAAGT | 104 | 923 |
| 875281 | N/A | N/A | 80384 | 80403 | CTGTAAAAGCCACCTTTCAG | 103 | 924 |
| 875305 | N/A | N/A | 82014 | 82033 | CAAGCTCTTCAAGATCTTGG | 90 | 925 |
| 875329 | N/A | N/A | 83868 | 83887 | TAAGTTACCTCAGATCCTTT | 52 | 926 |
| 875353 | N/A | N/A | 85058 | 85077 | CCAAAGGGTTAATTAGGATC | 52 | 927 |
| 875377 | N/A | N/A | 86878 | 86897 | TAGCCACCATGCCTGGCTTC | 98 | 928 |
| 875401 | N/A | N/A | 89788 | 89807 | CAATTACATGAATGTGCATC | 36 | 929 |
| 875425 | N/A | N/A | 92341 | 92360 | ATGGTGGTTTCAAATGTCAG | 39 | 930 |
| 875449 | N/A | N/A | 95227 95287 | 95246 95306 | TATATATGTAAATTATATCT | 128 | 931 |
| 875473 | N/A | N/A | 96913 | 96932 | TTGAACCCCACCTTATGCTA | 60 | 932 |
| 875497 | N/A | N/A | 98445 | 98464 | GGGCTATGAGCATGTCATGA | 71 | 933 |
| 875521 | N/A | N/A | 100335 | 100354 | ACAAAAGAAAGAAAACAGGA | 135 | 934 |
| 875545 | N/A | N/A | 103117 | 103136 | TATAATGACAACTTTAAAAC | 106 | 935 |

TABLE 13-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 875569 | N/A | N/A | 106756 | 106775 | TACAAAACAACCAGATAATA | 86 | 936 |
| 875593 | N/A | N/A | 110045 | 110064 | CTAGGCCATAGCTCCCAGAT | 99 | 937 |
| 875617 | N/A | N/A | 112430 | 112449 | AGTTTAGGAAAGGTGTTGGG | 128 | 938 |
| 875641 | N/A | N/A | 114754 | 114773 | CAATTTAAAAAAATTGCTA | 111 | 939 |
| 875665 | N/A | N/A | 116291 | 116310 | ACATTAGGCACCTATGATAA | 74 | 940 |
| 875689 | N/A | N/A | 119970 | 119989 | TTGAGACTCACTCTTTCACT | 71 | 941 |
| 875713 | N/A | N/A | 123039 | 123058 | GGCAAGGATGCAGAACACAT | 46 | 942 |
| 875737 | N/A | N/A | 125996 | 126015 | AGCCAAGATATATTTTAAAG | 84 | 943 |
| 875761 | N/A | N/A | 129221 | 129240 | CTTCATATATGGTACTTCAT | 46 | 944 |
| 875785* | N/A | N/A | 131273 | 131292 | TTTCCTCTGAACCTCTTACA | 77 | 945 |
| 875809 | N/A | N/A | 133039 | 133058 | TTAAAACTTTTATTCTTCAA | 87 | 946 |
| 875833 | N/A | N/A | 134752 | 134771 | TATTACAATATATTTAATAT | 79 | 947 |
| 875857 | N/A | N/A | 137346 137424 | 137365 137443 | TTTATACCAAGCTTGTGGCT | 98 | 948 |
| 875881 | N/A | N/A | 139301 | 139320 | CTGAAGCAAATTAAGTACAG | 65 | 949 |
| 875905 | N/A | N/A | 142335 | 142354 | CATACTCATTAAGTTTACTT | 60 | 950 |
| 875929 | N/A | N/A | 144073 | 144092 | TCTACATATGATATTAAAAT | 97 | 951 |
| 875953 | N/A | N/A | 146067 | 146086 | ACTCATGTGAGTAACAATCA | 65 | 952 |
| 875977 | N/A | N/A | 147547 | 147566 | TAACCCTTGACATTTCTGAT | 65 | 953 |

TABLE 14

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 45 | 32 |
| 708399 | 3483 | 3502 | 136956 | 136975 | TGTTGTATGGTAATTTGGGA | 29 | 954 |
| 874160 | 104 | 123 | 2094 | 2113 | GTGCGGATAGGGACTCTTTA | 98 | 955 |
| 874184 | 276 | 295 | 2266 | 2285 | CGCCACCGCCGCCCCGCCCG | 120 | 956 |
| 874208 | 987 | 1006 | N/A | N/A | CTTCACATTTGGAGCCAACA | 62 | 957 |
| 874230 | 1470 | 1489 | 81630 | 81649 | GGTTTGCCCTTGCTTCCCGT | 72 | 958 |
| 874253 | 1652 | 1671 | 83263 | 83282 | GACTTCTCTATTTCTTTGTC | 62 | 959 |
| 874277 | 2366 | 2385 | 91250 | 91269 | GGTAACAGCTCTGTTCGATG | 36 | 960 |
| 874301 | 2760 | 2779 | 113069 | 113088 | CCGTGTTACTAAGTATTGAA | 48 | 961 |
| 874347 | 4157 | 4176 | 148908 | 148927 | TCTGTGCTTCCAGTTGGTAG | 61 | 962 |
| 874371 | 4311 | 4330 | 149062 | 149081 | CAGCATATGGAATTATGGAA | 44 | 963 |

TABLE 14-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 874395 | 4481 | 4500 | 149232 | 149251 | GTTCCAAGTCTTGATTTTTT | 50 | 964 |
| 874418 | 4633 | 4652 | 149384 | 149403 | TTATATTATCTACAAAGTAA | 76 | 965 |
| 874442 | N/A | N/A | 146593 | 146612 | TCTGAGAGATAGATCCAACT | 62 | 966 |
| 874466 | N/A | N/A | 3522 | 3541 | CGCCGCCGCCTCGGACACGA | 79 | 967 |
| 874490 | N/A | N/A | 2936 | 2955 | GGACGGCGGCGCGGGCCGCG | 96 | 968 |
| 874514 | N/A | N/A | 5531 | 5550 | TTAAATGAACCCAGGAGACA | 106 | 969 |
| 874538 | N/A | N/A | 7992 | 8011 | GCCCAAACTTAAAAAGTTTA | 84 | 970 |
| 874562 | N/A | N/A | 10678 | 10697 | GCTCTGCCTCCCGGGTTTCA | 71 | 971 |
| 874586 | N/A | N/A | 14320 | 14339 | CATGACTTTAAAAAGCAATA | 59 | 972 |
| 874610 | N/A | N/A | 17158 | 17177 | TTTGAATTACAATGCGGTAT | 19 | 973 |
| 874634 | N/A | N/A | 19549 | 19568 | CAAGGCAAGAGGAGTACTTG | 87 | 974 |
| 874658 | N/A | N/A | 21350 | 21369 | GAGCAAGATCCTATCTCCGA | 67 | 975 |
| 874682 | N/A | N/A | 26160 | 26179 | TGTTTTCCTCTTCATCTAAA | 35 | 976 |
| 874706 | N/A | N/A | 28889 | 28908 | AGTCTTGTTCAGTGTCCTTC | 19 | 977 |
| 874730 | N/A | N/A | 31622 | 31641 | GAAATATTTAAATTTTAATC | 100 | 978 |
| 874754 | N/A | N/A | 32817 | 32836 | TTGTTCTTCCAATTTCAGAC | 12 | 979 |
| 874778 | N/A | N/A | 35640 | 35659 | AAAATTACTTCTCATTGACA | 67 | 980 |
| 874802 | N/A | N/A | 37398 | 37417 | GAATCATGCCTCATATGATA | 127 | 981 |
| 874826 | N/A | N/A | 38826 | 38845 | TCCACAGAAGCTAAATATAG | 113 | 982 |
| 874850 | N/A | N/A | 41826 | 41845 | AAATTGTTAAAATGGTATAT | 118 | 983 |
| 874874 | N/A | N/A | 43788 | 43807 | AACGATGATCTGGTATCCTG | 25 | 984 |
| 874898 | N/A | N/A | 45195 | 45214 | CTTGATTTAACCAACACAGA | 77 | 985 |
| 874922 | N/A | N/A | 46632 | 46651 | AAAATTTGTGATAGCTTCTC | 45 | 986 |
| 874946 | N/A | N/A | 48678 | 48697 | TTGGAGCCCTAAAAACATAT | 106 | 987 |
| 874970 | N/A | N/A | 51088 | 51107 | AATATTTCAATAGTATAAGT | 94 | 988 |
| 874994 | N/A | N/A | 53501 | 53520 | CACGCCACTGTACCCAGCCT | 107 | 989 |
| 875018 | N/A | N/A | 56070 | 56089 | GAAAAAGAGAACAAGGAGGT | 86 | 990 |
| 875042 | N/A | N/A | 58395 | 58414 | GAAGAGATCCCTGTTTGTTA | 78 | 991 |
| 875066 | N/A | N/A | 61057 | 61076 | CCACCTTTTCATACATTCAC | 71 | 992 |
| 875090 | N/A | N/A | 63149 | 63168 | TACCACCGTGTCTGGCTACT | 135 | 993 |
| 875114 | N/A | N/A | 65095 | 65114 | TGATACAGCCACTATGCCCA | 64 | 994 |
| 875138 | N/A | N/A | 68412 | 68431 | AATAAATTATTCCAACACAC | 88 | 995 |
| 875162 | N/A | N/A | 70035 | 70054 | ATATTAAAGACTATAATACT | 89 | 996 |
| 875186 | N/A | N/A | 72033 | 72052 | TGCCACCTGCTGGTGGTCAT | 95 | 997 |
| 875210 | N/A | N/A | 73774 | 73793 | TAAAGTTATGTGGATTGCTG | 82 | 998 |
| 875234 | N/A | N/A | 76018 | 76037 | CAGATGACTATCAGTAAAGG | 65 | 999 |

TABLE 14-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 875258 | N/A | N/A | 77592 | 77611 | CTATCAATTTATCCACCTCA | 84 | 1000 |
| 875282 | N/A | N/A | 80426 | 80445 | CATAAAATAGCCTTCAGATC | 83 | 1001 |
| 875306 | N/A | N/A | 82128 | 82147 | CTAGCTCCTCCTCATTCTGT | 59 | 1002 |
| 875330 | N/A | N/A | 83955 | 83974 | CCTTAGACTAAGGGTTGTTT | 75 | 1003 |
| 875354 | N/A | N/A | 85060 | 85079 | TCCCAAAGGGTTAATTAGGA | 52 | 1004 |
| 875378 | N/A | N/A | 87195 | 87214 | TCCTCACTCTCTCACCCGGC | 116 | 1005 |
| 875402 | N/A | N/A | 90101 | 90120 | CCTCCCGGGTCCTGGTTCAA | 68 | 1006 |
| 875426 | N/A | N/A | 92344 | 92363 | GCTATGGTGGTTTCAAATGT | 42 | 1007 |
| 875450 | N/A | N/A | 95228 95288 | 95247 95307 | TTATATATGTAAATTATATC | 103 | 1008 |
| 875474 | N/A | N/A | 96950 | 96969 | GTCAATTAGAAATAAAAAAT | 144 | 1009 |
| 875498 | N/A | N/A | 98617 | 98636 | CTAAAACCCACATTATTAAC | 87 | 1010 |
| 875522 | N/A | N/A | 100343 | 100362 | CATCCTCTACAAAAGAAAGA | 83 | 1011 |
| 875546 | N/A | N/A | 103265 | 103284 | TACAAAAATCAACACACAAA | 87 | 1012 |
| 875570 | N/A | N/A | 106843 | 106862 | AAAATCACTTTCAAAACAAG | 102 | 1013 |
| 875594 | N/A | N/A | 110104 | 110123 | TGGATACTAGTTCAGCCACA | 73 | 1014 |
| 875618 | N/A | N/A | 112541 | 112560 | TCAGACACTTCACAATAAAA | 96 | 1015 |
| 875642 | N/A | N/A | 114895 | 114914 | AAACCTACCTGAGAGAAGGA | 92 | 1016 |
| 875666 | N/A | N/A | 116299 | 116318 | AAAAATTAACATTAGGCACC | 108 | 1017 |
| 875690 | N/A | N/A | 120054 | 120073 | GTTTGGCAGTTCCATCACAG | 75 | 1018 |
| 875714 | N/A | N/A | 123199 | 123218 | TTACTAAAAAAAGGTTGACA | 101 | 1019 |
| 875738 | N/A | N/A | 126191 | 126210 | TTATTGTAAAAAGATTTATC | 95 | 1020 |
| 875762 | N/A | N/A | 129249 | 129268 | TAAAAACTAACATATAAACA | 94 | 1021 |
| 875786* | N/A | N/A | 131299 | 131318 | GTAAACTCTCAAATCTTTCT | 88 | 1022 |
| 875810 | N/A | N/A | 133116 | 133135 | GCATAAGCTGTGGGTTACAG | 41 | 1023 |
| 875834 | N/A | N/A | 134776 | 134795 | GTATTTGGTTCCTTTGAGAA | 33 | 1024 |
| 875858 | N/A | N/A | 137508 | 137527 | CTTAGTATTTCATCAATCCT | 41 | 1025 |
| 875882 | N/A | N/A | 139406 | 139425 | AGTGTTCCTTGACATAAATA | 56 | 1026 |
| 875906 | N/A | N/A | 142354 | 142373 | ACAGGCCCTCCATCATCATC | 71 | 1027 |
| 875930 | N/A | N/A | 144074 | 144093 | CTCTACATATGATATTAAAA | 89 | 1028 |
| 875954 | N/A | N/A | 146116 | 146135 | AGCAGATATATGGATAACCA | 29 | 1029 |
| 875978 | N/A | N/A | 147750 | 147769 | CATGTCAACTGTGTTCCTTT | 37 | 1030 |

TABLE 15

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 48 | 32 |
| 708490 | 4500 | 4519 | 149251 | 149270 | TCAAGTTTAGTAAAAGGGCG | 74 | 1031 |
| 874161 | 109 | 128 | 2099 | 2118 | CGGAGGTGCGGATAGGGACT | 78 | 1032 |
| 874185 | 281 | 300 | 2271 | 2290 | GGCCGCGCCACCGCCGCCCC | 91 | 1033 |
| 874209 | 989 | 1008 | N/A | N/A | TACTTCACATTTGGAGCCAA | 60 | 1034 |
| 874231 | 1471 | 1490 | 81631 | 81650 | TGGTTTGCCCTTGCTTCCCG | 65 | 1035 |
| 874254 | 1654 | 1673 | 83265 | 83284 | ATGACTTCTCTATTTCTTTG | 35 | 1036 |
| 874278 | 2385 | 2404 | N/A | N/A | CTTTAGCCTCACTAGAAGGG | 73 | 1037 |
| 874302 | 2761 | 2780 | 113070 | 113089 | TCCGTGTTACTAAGTATTGA | 64 | 1038 |
| 874325 | 3485 | 3504 | 136958 | 136977 | CTTGTTGTATGGTAATTTGG | 40 | 1039 |
| 874348 | 4171 | 4190 | 148922 | 148941 | TGAAATTCTAGTTTTCTGTG | 44 | 1040 |
| 874372 | 4316 | 4335 | 149067 | 149086 | TGAAACAGCATATGGAATTA | 69 | 1041 |
| 874419 | 4638 | 4657 | 149389 | 149408 | TTATTTTATATTATCTACAA | 91 | 1042 |
| 874443 | N/A | N/A | 146598 | 146617 | AGCCTTCTGAGAGATAGATC | 73 | 1043 |
| 874467 | N/A | N/A | 3527 | 3546 | GCCCCCGCCGCCGCCTCGGA | 73 | 1044 |
| 874491 | N/A | N/A | 2984 | 3003 | CTGCCGGCCCCCAGCCCACC | 106 | 1045 |
| 874515 | N/A | N/A | 5633 | 5652 | TGGCAAAATCCCGTCCTCAC | 139 | 1046 |
| 874539 | N/A | N/A | 8091 | 8110 | CACTGTTTCAGAATGTGGAA | 125 | 1047 |
| 874563 | N/A | N/A | 10828 | 10847 | GCATATAGCAAGAGATGTAG | 89 | 1048 |
| 874587 | N/A | N/A | 14339 | 14358 | ATTATTAAGAATATTTTAAC | 141 | 1049 |
| 874611 | N/A | N/A | 17212 | 17231 | GCAGAGCAGGACTAGTCCAT | 91 | 1050 |
| 874635 | N/A | N/A | 19575 | 19594 | GCCTTAATTTCAATACTTTG | 65 | 1051 |
| 874659 | N/A | N/A | 21398 | 21417 | GCAAGAGTTTCACTTGAGCC | 112 | 1052 |
| 874683 | N/A | N/A | 26226 | 26245 | CCCATTTCAGCCTCCCCATG | 115 | 1053 |
| 874707 | N/A | N/A | 28898 | 28917 | TACTGCTGAAGTCTTGTTCA | 98 | 1054 |
| 874731 | N/A | N/A | 31654 | 31673 | ACTTGAAATACGATTAGTAT | 67 | 1055 |
| 874755 | N/A | N/A | 32836 | 32855 | CTCACTTAGGTGAGTCATTT | 87 | 1056 |
| 874779 | N/A | N/A | 35967 | 35986 | TGAGATATAACAATATTGAA | 84 | 1057 |
| 874803 | N/A | N/A | 37400 | 37419 | AGGAATCATGCCTCATATGA | 85 | 1058 |
| 874827 | N/A | N/A | 39445 | 39464 | GCAGAAGGACCACTTAAGAC | 78 | 1059 |
| 874851 | N/A | N/A | 42179 | 42198 | AATACATATAAAAGCAATGC | 57 | 1060 |
| 874875 | N/A | N/A | 43912 | 43931 | TACCTCGCCTAACAAAAATT | 103 | 1061 |
| 874899 | N/A | N/A | 45357 | 45376 | ACCAGAGTCCAGGAGTCTGA | 125 | 1062 |
| 874923 | N/A | N/A | 46639 | 46658 | AGTCTCAAAAATTTGTGATA | 82 | 1063 |
| 874947 | N/A | N/A | 48833 | 48852 | ATCATTCAAAGTGGCTTTAA | 41 | 1064 |
| 874971 | N/A | N/A | 51100 | 51119 | TTATAACAGAGGAATATTTC | 107 | 1065 |

TABLE 15-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 874995 | N/A | N/A | 53763 | 53782 | ATCCTTTAACAACCATGGAA | 79 | 1066 |
| 875019 | N/A | N/A | 56364 | 56383 | GGTATAAAAGAGCAAGGAGA | 100 | 1067 |
| 875043 | N/A | N/A | 58428 | 58447 | CCGTAAACAGCTTTTCTAAT | 82 | 1068 |
| 875067 | N/A | N/A | 61071 | 61090 | ACAAGTGAGGAGGGCCACCT | 99 | 1069 |
| 875091 | N/A | N/A | 63212 | 63231 | ATCTCCCTGCGCTCAGATGA | 95 | 1070 |
| 875115 | N/A | N/A | 65108 65149 | 65127 65168 | TAGGATTGTAAAATGATACA | 61 | 1071 |
| 875139 | N/A | N/A | 68476 | 68495 | ATGGAACAGAACTTAGGAGG | 59 | 1072 |
| 875163 | N/A | N/A | 70051 | 70070 | ATGTATTATACAGATTATAT | 74 | 1073 |
| 875187 | N/A | N/A | 72064 | 72083 | GGGCAGAAACTTAGTCATTT | 82 | 1074 |
| 875211 | N/A | N/A | 73872 | 73891 | TCTTACCAACACCTCATCTT | 87 | 1075 |
| 875235 | N/A | N/A | 76039 | 76058 | TTAATTTAGCAAATGGAATC | 117 | 1076 |
| 875259 | N/A | N/A | 77632 | 77651 | AAATTTTGATTAGCATTGCC | 60 | 1077 |
| 875283 | N/A | N/A | 80616 | 80635 | GTTATAACCAACATCTATAT | 97 | 1078 |
| 875307 | N/A | N/A | 82190 | 82209 | CTATTATCTTATCACAAAAT | 108 | 1079 |
| 875331 | N/A | N/A | 83977 | 83996 | GTTGCTAAACTGTAACATCC | 91 | 1080 |
| 875355 | N/A | N/A | 85061 | 85080 | TTCCCAAAGGGTTAATTAGG | 63 | 1081 |
| 875379 | N/A | N/A | 87247 | 87266 | GCCTACTGGTGTTAACACCA | 89 | 1082 |
| 875403 | N/A | N/A | 90168 | 90187 | AATGGAGTCTCACTCTATAG | 72 | 1083 |
| 875427 | N/A | N/A | 92352 | 92371 | TAAGCTGTGCTATGGTGGTT | 27 | 1084 |
| 875451 | N/A | N/A | 95230 95290 | 95249 95309 | ATTTATATATGTAAATTATA | 140 | 1085 |
| 875475 | N/A | N/A | 96989 | 97008 | ACTTACACAGTAAAAATGGT | 70 | 1086 |
| 875499 | N/A | N/A | 98735 | 98754 | ACACTATGAAGCAGGTTCTA | 66 | 1087 |
| 875523 | N/A | N/A | 100418 | 100437 | TAAGTGATGAGGTTTTTAAG | 80 | 1088 |
| 875547 | N/A | N/A | 103306 | 103325 | ACCTATTAGAACTGACAAAC | 122 | 1089 |
| 875571 | N/A | N/A | 107260 | 107279 | GGGTTATAAAATGTTATTTG | 35 | 1090 |
| 875595 | N/A | N/A | 110110 | 110129 | GCAATGTGGATACTAGTTCA | 52 | 1091 |
| 875619 | N/A | N/A | 112569 | 112588 | TCCTCTTATACTTGTCATTT | 126 | 1092 |
| 875643 | N/A | N/A | 114953 | 114972 | AGGACTATTACTAATAATTT | 72 | 1093 |
| 875667 | N/A | N/A | 116631 | 116650 | CACACCAGGCCTCCAATTAC | 85 | 1094 |
| 875691 | N/A | N/A | 120228 | 120247 | GGGCACGATCTCAAAACAAT | 70 | 1095 |
| 875715 | N/A | N/A | 123671 | 123690 | TGCAAAGACAGGGTTTTGTC | 86 | 1096 |
| 875739 | N/A | N/A | 126238 | 126257 | AAACAAATCCAAATTGCAAG | 54 | 1097 |
| 875763 | N/A | N/A | 129540 | 129559 | TACAAAAATATTAGCCAGCT | 83 | 1098 |
| 875787* | N/A | N/A | 131307 | 131326 | AAACAGCTGTAAACTCTCAA | 81 | 1099 |
| 875811 | N/A | N/A | 133194 | 133213 | AAACTAAACACCTTTGATCA | 80 | 1100 |

TABLE 15-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 875835 | N/A | N/A | 134893 | 134912 | AAAAGGTGACATAAAATTGT | 119 | 1101 |
| 875859 | N/A | N/A | 137537 | 137556 | AGCCATGCACAGGACTGAAA | 104 | 1102 |
| 875883 | N/A | N/A | 139441 | 139460 | CTTTGGTCCAGACCTAGTCC | 63 | 1103 |
| 875907 | N/A | N/A | 142390 | 142409 | AAGACAGTCCTTTTTTCTA | 52 | 1104 |
| 875931 | N/A | N/A | 144082 | 144101 | TAATACAGCTCTACATATGA | 95 | 1105 |
| 875955 | N/A | N/A | 146118 | 146137 | AAAGCAGATATATGGATAAC | 94 | 1106 |
| 875979 | N/A | N/A | 147776 | 147795 | ACAGGCAACATCTCCGGCTT | 86 | 1107 |

TABLE 16

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 26 | 32 |
| 874162 | 114 | 133 | 2104 | 2123 | GGGAGCGGAGGTGCGGATAG | 114 | 1108 |
| 874186 | 301 | 320 | 2291 | 2310 | GCGGAGGGATACGGTCCCGG | 119 | 1109 |
| 874210 | 990 | 1009 | N/A | N/A | GTACTTCACATTTGGAGCCA | 46 | 1110 |
| 874232 | 1473 | 1492 | 81633 | 81652 | ACTGGTTTGCCCTTGCTTCC | 90 | 1111 |
| 874255 | 1656 | 1675 | 83267 | 83286 | ATATGACTTCTCTATTTCTT | 48 | 1112 |
| 874279 | 2458 | 2477 | 91728 | 91747 | GATGTTTCATTGGGTTTAAT | 25 | 1113 |
| 874303 | 2762 | 2781 | 113071 | 113090 | CTCCGTGTTACTAAGTATTG | 73 | 1114 |
| 874326 | 3486 | 3505 | 136959 | 136978 | CCTTGTTGTATGGTAATTTG | 45 | 1115 |
| 874349 | 4176 | 4195 | 148927 | 148946 | ATAAATGAAATTCTAGTTTT | 150 | 1116 |
| 874373 | 4321 | 4340 | 149072 | 149091 | GACTCTGAAACAGCATATGG | 82 | 1117 |
| 874396 | 4505 | 4524 | 149256 | 149275 | CTTTGTCAAGTTTAGTAAAA | 78 | 1118 |
| 874420 | 4643 | 4662 | 149394 | 149413 | AGTTTTTATTTTATATTATC | 95 | 1119 |
| 874444 | N/A | N/A | 146603 | 146622 | AAGGTAGCCTTCTGAGAGAT | 60 | 1120 |
| 874468 | N/A | N/A | 3532 | 3551 | CGGGAGCCCCCGCCGCCGCC | 92 | 1121 |
| 874492 | N/A | N/A | 2996 | 3015 | GTCTCCCCCGCGCTGCCGGC | 89 | 1122 |
| 874516 | N/A | N/A | 5636 | 5655 | ACATGGCAAAATCCCGTCCT | 96 | 1123 |
| 874540 | N/A | N/A | 8113 | 8132 | ACCATGACTGATCCCATGTT | 78 | 1124 |
| 874564 | N/A | N/A | 10830 | 10849 | CTGCATATAGCAAGAGATGT | 68 | 1125 |
| 874588 | N/A | N/A | 14371 | 14390 | AATTATAATCAAGATTAATT | 89 | 1126 |
| 874612 | N/A | N/A | 17241 | 17260 | AAAAATTCATTGAACTGTTG | 70 | 1127 |
| 874636 | N/A | N/A | 19633 | 19652 | CTACTATGTGCCAAGAACAG | 90 | 1128 |
| 874660 | N/A | N/A | 21433 | 21452 | GCCTGTAATCCCTCCCAACA | 134 | 1129 |

TABLE 16-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 874684 | N/A | N/A | 26574 | 26593 | TGTTTCCCTCCCTTTTTAAT | 71 | 1130 |
| 874708 | N/A | N/A | 29092 | 29111 | AACAGCAAAAGGTAGGCTAG | 66 | 1131 |
| 874732 | N/A | N/A | 31705 | 31724 | TATGTCATGCTGTCCAATAT | 86 | 1132 |
| 874756 | N/A | N/A | 32845 | 32864 | TAAGGTTAACTCACTTAGGT | 68 | 1133 |
| 874780 | N/A | N/A | 35982 | 36001 | TGCCTCTCTATTCCCTGAGA | 68 | 1134 |
| 874804 | N/A | N/A | 37534 | 37553 | AAGGCACATTGTGTGGCCAA | 104 | 1135 |
| 874828 | N/A | N/A | 39544 | 39563 | CCCGGCCTCGAGACTCCACC | 81 | 1136 |
| 874852 | N/A | N/A | 42204 | 42223 | TAGGAGGAGAACTTATGAAT | 56 | 1137 |
| 874876 | N/A | N/A | 44007 | 44026 | AGCTGGTATTTAAACCAGGT | 128 | 1138 |
| 874900 | N/A | N/A | 45369 | 45388 | TGAGGCAGGATCACCAGAGT | 46 | 1139 |
| 874924 | N/A | N/A | 46715 | 46734 | CAACCACACTACTCCATATT | 85 | 1140 |
| 874948 | N/A | N/A | 48866 | 48885 | TAAAATAATCAGTATTTGAA | 87 | 1141 |
| 874972 | N/A | N/A | 51110 | 51129 | ATTTTTGAATTTATAACAGA | 134 | 1142 |
| 874996 | N/A | N/A | 54214 | 54233 | AGGTTTCCCTGGCTGGGCGC | 79 | 1143 |
| 875020 | N/A | N/A | 56850 | 56869 | GGACCTGGCAGTTAGAGGTT | 90 | 1144 |
| 875044 | N/A | N/A | 58517 | 58536 | CTGGCCTCAATAAGTGCCAC | 90 | 1145 |
| 875068 | N/A | N/A | 61079 | 61098 | AAATCATTACAAGTGAGGAG | 47 | 1146 |
| 875092 | N/A | N/A | 63237 | 63256 | TCTCACTTGGCTCACTGCAG | 69 | 1147 |
| 875116 | N/A | N/A | 65143 | 65162 | TGTAAAATGATACAGCTACG | 81 | 1148 |
| 875140 | N/A | N/A | 68607 | 68626 | AGAAGTGTAAAGTTTATAGC | 112 | 1149 |
| 875164 | N/A | N/A | 70065 | 70084 | TATACTACTACACCATGTAT | 159 | 1150 |
| 875212 | N/A | N/A | 73918 | 73937 | TGAATTTTGGAAAATCTCTC | 94 | 1151 |
| 875236 | N/A | N/A | 76149 | 76168 | AGACCAATGCACTATAATAA | 117 | 1152 |
| 875284 | N/A | N/A | 80623 | 80642 | TCATTCAGTTATAACCAACA | 60 | 1153 |
| 875308 | N/A | N/A | 82230 | 82249 | ATAAACTCTTCTCCCAACTC | 68 | 1154 |
| 875332 | N/A | N/A | 84070 | 84089 | AAAGATCCACAACCTACAAG | 87 | 1155 |
| 875356 | N/A | N/A | 85062 | 85081 | GTTCCCAAAGGGTTAATTAG | 177 | 1156 |
| 875380 | N/A | N/A | 87346 | 87365 | CTGCCATGCCACTAGTGACT | 73 | 1157 |
| 875404 | N/A | N/A | 90195 | 90214 | GAAGCAGATTTTTTTTTTTT | 27 | 1158 |
| 875428 | N/A | N/A | 92385 | 92404 | TCACTGAACAAAGTACAAAT | 68 | 1159 |
| 875452 | N/A | N/A | 95260 95320 | 95279 95339 | AACCACTGATTTATACACTT | 20 | 1160 |
| 875476 | N/A | N/A | 97064 | 97083 | TGCCTGGCCAAGAATAGTCT | 100 | 1161 |
| 875500 | N/A | N/A | 98816 | 98835 | GAACATGTATTGAATACATA | 55 | 1162 |
| 875524 | N/A | N/A | 100442 | 100461 | CAGAAGACAAAGATATTAGC | 128 | 1163 |
| 875548 | N/A | N/A | 104013 | 104032 | ATATTATTTATACTGTGTAT | 50 | 1164 |

TABLE 16-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 875572 | N/A | N/A | 107323 | 107342 | GTTTTCTCTTTGCTTGCTTG | 23 | 1165 |
| 875596 | N/A | N/A | 110114 | 110133 | TCTTGCAATGTGGATACTAG | 79 | 1166 |
| 875620 | N/A | N/A | 112575 | 112594 | TTTCTATCCTCTTATACTTG | 71 | 1167 |
| 875644 | N/A | N/A | 114990 | 115009 | CACACTAAAACAAAATTCAG | 96 | 1168 |
| 875668 | N/A | N/A | 117316 | 117335 | GCTCTCGAACTCATGGGTTC | 144 | 1169 |
| 875692 | N/A | N/A | 120399 | 120418 | AGCCTGGGAAGCACGGAGAA | 83 | 1170 |
| 875716 | N/A | N/A | 123804 | 123823 | ATCACCCCTCCATCGCCCTC | 93 | 1171 |
| 875740 | N/A | N/A | 126330 | 126349 | TAGGTGACAGAGCCAAGATT | 110 | 1172 |
| 875764 | N/A | N/A | 129790 | 129809 | TGTTACTTATTACCTTCCTG | 30 | 1173 |
| 875788* | N/A | N/A | 131325 | 131344 | TGGTTTCCAGATTTCCAGAA | 75 | 1174 |
| 875812 | N/A | N/A | 133282 | 133301 | CACAATTTTTTATTTAAAAT | 195 | 1175 |
| 875836 | N/A | N/A | 134901 | 134920 | TGAATGAGAAAAGGTGACAT | 101 | 1176 |
| 875860 | N/A | N/A | 137712 | 137731 | GCCAGCATGCATGGCTGATT | 97 | 1177 |
| 875884 | N/A | N/A | 139457 | 139476 | TCAAAGACATATGCTTCTTT | 70 | 1178 |
| 875908 | N/A | N/A | 142421 | 142440 | CTTCCTGAGCTTCACAGTCC | 61 | 1179 |
| 875932 | N/A | N/A | 144151 | 144170 | ATTTAAACCATCCATTGTCT | 70 | 1180 |
| 875956 | N/A | N/A | 146131 | 146150 | ACAACTTATGGTCAAAGCAG | 29 | 1181 |
| 875980 | N/A | N/A | 147793 | 147812 | AGAGCTCTTTTACGCATACA | 71 | 1182 |

TABLE 17

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 26 | 32 |
| 874163 | 153 | 172 | 2143 | 2162 | CTGAGCGCATCGGAGGGCGG | 113 | 1183 |
| 874187 | 353 | 372 | 2343 | 2362 | AGGCGAGCTCTGCCGGGAGG | 83 | 1184 |
| 874211 | 991 | 1010 | 48690 | 48709 | TGTACTTCACATTTGGAGCC | 25 | 1185 |
| 874233 | 1475 | 1494 | 81635 | 81654 | TAACTGGTTTGCCCTTGCTT | 65 | 1186 |
| 874256 | 1758 | 1777 | 83369 | 83388 | AATTCGGGTTGAAATCTGAA | 81 | 1187 |
| 874280 | 2460 | 2479 | 91730 | 91749 | GTGATGTTTCATTGGGTTTA | 6 | 1188 |
| 874304 | 2764 | 2783 | 113073 | 113092 | TGCTCCGTGTTACTAAGTAT | 48 | 1189 |
| 874327 | 3487 | 3506 | 136960 | 136979 | TCCTTGTTGTATGGTAATTT | 23 | 1190 |
| 874350 | 4181 | 4200 | 148932 | 148951 | ACAAAATAAATGAAATTCTA | 80 | 1191 |
| 874397 | 4510 | 4529 | 149261 | 149280 | TGAAACTTTGTCAAGTTTAG | 74 | 1192 |
| 874421 | 4648 | 4667 | 149399 | 149418 | TTTTAAGTTTTTATTTTATA | 82 | 1193 |

TABLE 17-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 874469 | N/A | N/A | 3537 | 3556 | GAGTTCGGGAGCCCCGCCG | 85 | 1194 |
| 874493 | N/A | N/A | 3003 | 3022 | CGAGCGAGTCTCCCCCGCGC | 98 | 1195 |
| 874517 | N/A | N/A | 5901 | 5920 | AAAAGCAAAATAAGAATTA | 77 | 1196 |
| 874541 | N/A | N/A | 8117 | 8136 | GAACACCATGACTGATCCCA | 23 | 1197 |
| 874565 | N/A | N/A | 10902 | 10921 | TAGCACCTGAGCCCCACCTG | 70 | 1198 |
| 874589 | N/A | N/A | 14504 | 14523 | CTTCAATTCCTGATTTCGAA | 74 | 1199 |
| 874613 | N/A | N/A | 17561 | 17580 | AAAAAAAATTTTTGGCTAGG | 78 | 1200 |
| 874637 | N/A | N/A | 19886 | 19905 | TTTCAAGTCTATCAACAGAT | 63 | 1201 |
| 874661 | N/A | N/A | 21470 | 21489 | AATGGGAAGAAAGAGGAGGC | 78 | 1202 |
| 874685 | N/A | N/A | 26678 | 26697 | GAGGACAGGATAACAGATTA | 31 | 1203 |
| 874709 | N/A | N/A | 29104 | 29123 | GAGTTGAAGTCTAACAGCAA | 44 | 1204 |
| 874733 | N/A | N/A | 31730 | 31749 | ACTTTGTACAATGATGAAGA | 87 | 1205 |
| 874757 | N/A | N/A | 32856 | 32875 | GTTCCACCTCTTAAGGTTAA | 59 | 1206 |
| 874781 | N/A | N/A | 36132 36238 | 36151 36257 | TTATAGTAATCTGTAATCAG | 56 | 1207 |
| 874805 | N/A | N/A | 37550 | 37569 | ATAGATATAGCCCCCAAAGG | 165 | 1208 |
| 874829 | N/A | N/A | 39845 | 39864 | GCAAGACTCCGTCTTTCTGT | 93 | 1209 |
| 874853 | N/A | N/A | 42212 | 42231 | AAACATCATAGGAGGAGAAC | 108 | 1210 |
| 874877 | N/A | N/A | 44056 | 44075 | CTCAGCAGTCAAGTATCTTG | 68 | 1211 |
| 874901 | N/A | N/A | 45525 | 45544 | AGAAGGAAGCAAACTAGAAA | 74 | 1212 |
| 874925 | N/A | N/A | 46792 | 46811 | CAGGTCATACCTTCATAGAA | 62 | 1213 |
| 874949 | N/A | N/A | 48877 | 48896 | AAACCAGTCTATAAAATAAT | 92 | 1214 |
| 874973 | N/A | N/A | 51139 | 51158 | TTCAACTAAAATTTTATCTT | 182 | 1215 |
| 874997 | N/A | N/A | 54231 | 54250 | ACTCCGCCTCAAAATAAAGG | 79 | 1216 |
| 875021 | N/A | N/A | 56853 | 56872 | AAAGGACCTGGCAGTTAGAG | 93 | 1217 |
| 875045 | N/A | N/A | 58639 | 58658 | TAATAAACATGTAATGCTTT | 100 | 1218 |
| 875069 | N/A | N/A | 61085 | 61104 | TTTCTTAAATCATTACAAGT | 81 | 1219 |
| 875093 | N/A | N/A | 63247 | 63266 | GAAACCAGGGTCTCACTTGG | 95 | 1220 |
| 875117 | N/A | N/A | 65191 | 65210 | GGTGAGGATGTGAAAAACAT | 119 | 1221 |
| 875141 | N/A | N/A | 68674 | 68693 | GATTAGGAGTAGACAGAGTT | 90 | 1222 |
| 875165 | N/A | N/A | 70194 | 70213 | TGTATAAACATTTTCTGAAT | 67 | 1223 |
| 875189 | N/A | N/A | 72110 | 72129 | GCTACCCCACAGCAGTGGG | 90 | 1224 |
| 875213 | N/A | N/A | 73928 | 73947 | TAGAAATGGCTGAATTTTGG | 69 | 1225 |
| 875237 | N/A | N/A | 76502 | 76521 | GTCATACTGACCAGAGTCTA | 158 | 1226 |
| 875285 | N/A | N/A | 80645 | 80664 | ATGTCAAAGTAGTTGTTCCC | 103 | 1227 |
| 875309 | N/A | N/A | 82340 | 82359 | TGCTGCACCTGACACAGATC | 93 | 1228 |

TABLE 17-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 875333 | N/A | N/A | 84072 | 84091 | GAAAAGATCCACAACCTACA | 63 | 1229 |
| 875357 | N/A | N/A | 85116 | 85135 | AATTCACATTTTACTTTAAC | 101 | 1230 |
| 875405 | N/A | N/A | 90206 | 90225 | ACAGAATAGCTGAAGCAGAT | 34 | 1231 |
| 875429 | N/A | N/A | 92388 | 92407 | GCTTCACTGAACAAAGTACA | 80 | 1232 |
| 875453 | N/A | N/A | 95293 | 95312 | TTGATTTATATATGTAAATT | 101 | 1233 |
| 875477 | N/A | N/A | 97173 | 97192 | GACATGCGGTTTCACCATTT | 28 | 1234 |
| 875501 | N/A | N/A | 98850 | 98869 | AATACTGGGTCATCTATATT | 108 | 1235 |
| 875525 | N/A | N/A | 100484 | 100503 | ACCTTTAAAGTAGACTGCAA | 60 | 1236 |
| 875549 | N/A | N/A | 104018 | 104037 | TATATATATTATTTATACTG | 104 | 1237 |
| 875573 | N/A | N/A | 107414 | 107433 | ACTACAGTTTTTTAAGACAT | 63 | 1238 |
| 875597 | N/A | N/A | 110197 | 110216 | GAGTGCTTGTGCCAGCCTTC | 117 | 1239 |
| 875621 | N/A | N/A | 112598 | 112617 | TGGGTGAGAAAAATATGAAA | 108 | 1240 |
| 875645 | N/A | N/A | 114996 | 115015 | GTTCAGCACACTAAAACAAA | 68 | 1241 |
| 875669 | N/A | N/A | 117334 | 117353 | CACTATATTGCCCATGCTGC | 135 | 1242 |
| 875693 | N/A | N/A | 120627 | 120646 | ACCTATAGTCAGGGCATGGT | 70 | 1243 |
| 875717 | N/A | N/A | 123819 | 123838 | CTCACTGCAACCTCGATCAC | 87 | 1244 |
| 875741 | N/A | N/A | 126725 | 126744 | AAAATACAAGGCCGGGCGCA | 352 | 1245 |
| 875765 | N/A | N/A | 129856 | 129875 | ACTTTTATCAAATGAAAGTT | 139 | 1246 |
| 875789* | N/A | N/A | 131417 | 131436 | CATGAGGATGCTGTGTTCAA | 67 | 1247 |
| 875813 | N/A | N/A | 133329 | 133348 | TACGGATGGGCCTCTTGAAA | 41 | 1248 |
| 875837 | N/A | N/A | 134997 | 135016 | CATACTAAAAATTTAAAAAC | 80 | 1249 |
| 875861 | N/A | N/A | 137893 | 137912 | TTAAGCTCAAGATATCCTGA | 37 | 1250 |
| 875885 | N/A | N/A | 139585 | 139604 | CATTCTGGCTAAAGATCCCA | 96 | 1251 |
| 875933 | N/A | N/A | 144213 | 144232 | TGAACTTTCTTGATGGTTAC | 64 | 1252 |
| 875957 | N/A | N/A | 146218 | 146237 | TGCTCTTAAAGAAAAATGGG | 66 | 1253 |
| 875981 | N/A | N/A | 147796 | 147815 | CAGAGAGCTCTTTTACGCAT | 51 | 1254 |

TABLE 18

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 28 | 32 |
| 760782 | 1479 | 1498 | 81639 | 81658 | CTGCTAACTGGTTTGCCCTT | 55 | 1255 |
| 874164 | 158 | 177 | 2148 | 2167 | GGCCGCTGAGCGCATCGGAG | 104 | 1256 |
| 874188 | 358 | 377 | 2348 | 2367 | GAGGGAGGCGAGCTCTGCCG | 94 | 1257 |

TABLE 18-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 874212 | 993 | 1012 | 48692 | 48711 | CTTGTACTTCACATTTGGAG | 27 | 1258 |
| 874257 | 1760 | 1779 | 83371 | 83390 | AGAATTCGGGTTGAAATCTG | 57 | 1259 |
| 874281 | 2461 | 2480 | 91731 | 91750 | GGTGATGTTTCATTGGGTTT | 22 | 1260 |
| 874305 | 2765 | 2784 | 113074 | 113093 | GTGCTCCGTGTTACTAAGTA | 64 | 1261 |
| 874328 | 3489 | 3508 | 136962 | 136981 | TCTCCTTGTTGTATGGTAAT | 42 | 1262 |
| 874351 | 4186 | 4205 | 148937 | 148956 | TAAAAACAAAATAAATGAAA | 100 | 1263 |
| 874375 | 4331 | 4350 | 149082 | 149101 | GTACCTGCGGGACTCTGAAA | 81 | 1264 |
| 874398 | 4515 | 4534 | 149266 | 149285 | TTTACTGAAACTTTGTCAAG | 69 | 1265 |
| 874422 | 4653 | 4672 | 149404 | 149423 | ATTTTTTTTAAGTTTTTATT | 128 | 1266 |
| 874470 | N/A | N/A | 3557 | 3576 | GGAGCCCCACGATTTCAGGG | 65 | 1267 |
| 874494 | N/A | N/A | 3037 | 3056 | CTGCGCCCACCGGCCGAGCC | 93 | 1268 |
| 874518 | N/A | N/A | 6371 | 6390 | AAAAATGTTCACTGCACCAC | 67 | 1269 |
| 874542 | N/A | N/A | 8121 | 8140 | AAAGGAACACCATGACTGAT | 66 | 1270 |
| 874566 | N/A | N/A | 10936 | 10955 | GAACCAGACTGCACAACAGG | 82 | 1271 |
| 874590 | N/A | N/A | 14650 | 14669 | GCTAAAGCAGGAGGACAGTT | 111 | 1272 |
| 874614 | N/A | N/A | 17582 | 17601 | ATATCAATAAAAAATTACTT | 71 | 1273 |
| 874638 | N/A | N/A | 19928 | 19947 | ATCATTACGACCATTCTGCT | 61 | 1274 |
| 874662 | N/A | N/A | 21807 | 21826 | AGGAGCGCGCCACCGTGCCT | 98 | 1275 |
| 874686 | N/A | N/A | 26733 | 26752 | GAATTTGAATAGGTCATTTA | 89 | 1276 |
| 874710 | N/A | N/A | 29848 | 29867 | CTGAGATCAGGAGACCAGCC | 125 | 1277 |
| 874734 | N/A | N/A | 31806 | 31825 | CCTAGACACACCAAAAAATC | 119 | 1278 |
| 874758 | N/A | N/A | 32891 | 32910 | ATCAGTTAGACAATTAACTA | 80 | 1279 |
| 874782 | N/A | N/A | 36313 | 36332 | TGCTCTCTTTGCGCCTGTGT | 31 | 1280 |
| 874806 | N/A | N/A | 37712 | 37731 | TGTCATATACCCACTACTCA | 37 | 1281 |
| 874830 | N/A | N/A | 40133 | 40152 | CATAAAATTAAAATACTACA | 77 | 1282 |
| 874854 | N/A | N/A | 42262 | 42281 | ACCACGCCCGGCCAAAGATG | 117 | 1283 |
| 874878 | N/A | N/A | 44068 | 44087 | AGGAAACTGAACCTCAGCAG | 112 | 1284 |
| 874902 | N/A | N/A | 45563 | 45582 | CACTGCTTGCCTGGAGACCC | 125 | 1285 |
| 874926 | N/A | N/A | 46840 | 46859 | GAAATGTACCCTAAGAAGGG | 111 | 1286 |
| 874950 | N/A | N/A | 49008 | 49027 | TCTTAAGTACATTAATAATA | 115 | 1287 |
| 874974 | N/A | N/A | 51158 | 51177 | CAGAGTGCTATGTATTAAAT | 52 | 1288 |
| 874998 | N/A | N/A | 54550 | 54569 | GAACTTAAAAGTCACACTGA | 134 | 1289 |
| 875022 | N/A | N/A | 56884 | 56903 | AAGTGCAGCAATAAAGACAG | 95 | 1290 |
| 875046 | N/A | N/A | 58702 | 58721 | ATTTCTATATACTCTAAAAA | 86 | 1291 |
| 875070 | N/A | N/A | 61108 | 61127 | CAATAAAATAAAAATAAACT | 87 | 1292 |
| 875094 | N/A | N/A | 63266 | 63285 | TAGTAACCTTTTTTTTTTTG | 73 | 1293 |

TABLE 18-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 875118 | N/A | N/A | 65226 | 65245 | GGGTATAATCAAAGAGACAG | 85 | 1294 |
| 875142 | N/A | N/A | 68733 | 68752 | TACATTCCTAACTAATCAGC | 137 | 1295 |
| 875166 | N/A | N/A | 70825 | 70844 | AAAAACAAAAAAATGTGTAT | 135 | 1296 |
| 875190 | N/A | N/A | 72135 | 72154 | TCCAGCCCCTGTATCCCACC | 70 | 1297 |
| 875214 | N/A | N/A | 74077 | 74096 | GGAATAAAAGCATTAATCCA | 148 | 1298 |
| 875238 | N/A | N/A | 76541 | 76560 | CAACAAAAGCACATTTAAAT | 75 | 1299 |
| 875262 | N/A | N/A | 77753 | 77772 | TCTGCAGAAAAAGAAAAAAA | 117 | 1300 |
| 875286 | N/A | N/A | 80664 | 80683 | ATGAAGCTTGTTTTTCAAAA | 98 | 1301 |
| 875310 | N/A | N/A | 82410 | 82429 | CCAACAGGGTGCTCTTTAGC | 52 | 1302 |
| 875334 | N/A | N/A | 84147 | 84166 | AAGTTAGTAACATACTATTG | 64 | 1303 |
| 875358 | N/A | N/A | 85131 | 85150 | AACTTAACTGACATAAATTC | 73 | 1304 |
| 875382 | N/A | N/A | 87622 | 87641 | ACACCCCGATACCACTAAAA | 112 | 1305 |
| 875406 | N/A | N/A | 90234 | 90253 | AGACCATCTAAGTAATGTCA | 43 | 1306 |
| 875430 | N/A | N/A | 92407 | 92426 | CTTGCTCTACTAATATCTAG | 83 | 1307 |
| 875454 | N/A | N/A | 95304 | 95323 | ACTTTAAATGGTTGATTTAT | 66 | 1308 |
| 875478 | N/A | N/A | 97379 | 97398 | ATGTGAAGATAATTCAATGG | 71 | 1309 |
| 875502 | N/A | N/A | 98921 | 98940 | AGCAGAAAACTGAAATTCTT | 64 | 1310 |
| 875526 | N/A | N/A | 101064 | 101083 | AATTTTAAAGGCCGGGCACG | 125 | 1311 |
| 875550 | N/A | N/A | 104158 | 104177 | CGAATTCAGTAACACATTAA | 78 | 1312 |
| 875574 | N/A | N/A | 108028 | 108047 | AAGAACTACAATTTTTTTTT | 82 | 1313 |
| 875598 | N/A | N/A | 110258 | 110277 | TCATAGTCAGTGGACTTGGG | 79 | 1314 |
| 875622 | N/A | N/A | 112622 | 112641 | CCACATGTCAGAAATTGTGC | 71 | 1315 |
| 875646 | N/A | N/A | 115026 | 115045 | ATGGCCATGTAAAAAAAAGA | 82 | 1316 |
| 875670 | N/A | N/A | 117477 | 117496 | GTAGGTATATATAAAGCAAG | 34 | 1317 |
| 875694 | N/A | N/A | 120644 | 120663 | AAGCAAGTAAAAAGATAACC | 136 | 1318 |
| 875718 | N/A | N/A | 123915 | 123934 | TCACAGTAAGAAAAGAAACA | 86 | 1319 |
| 875742 | N/A | N/A | 127208 | 127227 | GACAAGACAAGAAAAGAAAA | 142 | 1320 |
| 875766 | N/A | N/A | 129887 | 129906 | TAAACAAAAAAGCCACTGAA | 103 | 1321 |
| 875790* | N/A | N/A | 131421 | 131440 | TAGACATGAGGATGCTGTGT | 81 | 1322 |
| 875814 | N/A | N/A | 133409 | 133428 | AACTAAAGACAAGTCAAATG | 89 | 1323 |
| 875838 | N/A | N/A | 135021 | 135040 | TAATGTTAGCATATGTGTAT | 51 | 1324 |
| 875862 | N/A | N/A | 137974 | 137993 | CTATTTCTGTACTTTTTGCC | 42 | 1325 |
| 875886 | N/A | N/A | 139601 | 139620 | TTTTGTTATATATGCTCATT | 37 | 1326 |
| 875910 | N/A | N/A | 142529 | 142548 | TGCCAGAATATTTTAACAAG | 61 | 1327 |
| 875934 | N/A | N/A | 144707 | 144726 | AGTTTCACAGTGTTCGCCAG | 55 | 1328 |

TABLE 18-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 875958 | N/A | N/A | 146252 | 146271 | ACACTGGAGGTGAGCTCCAA | 112 | 1329 |
| 875982 | N/A | N/A | 147991 | 148010 | CCTGCACACACACGCCTCAC | 135 | 1330 |

TABLE 19

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 45 | 32 |
| 874165 | 163 | 182 | 2153 | 2172 | GCTGCGGCCGCTGAGCGCAT | 111 | 1331 |
| 874189 | 363 | 382 | 2353 | 2372 | AGGCGGAGGGAGGCGAGCTC | 100 | 1332 |
| 874213 | 994 | 1013 | 48693 | 48712 | ACTTGTACTTCACATTTGGA | 49 | 1333 |
| 874234 | 1533 | 1552 | 81693 | 81712 | CATCATTTTCCAGGGCCACT | 53 | 1334 |
| 874258 | 1762 | 1781 | 83373 | 83392 | CCAGAATTCGGGTTGAAATC | 42 | 1335 |
| 874282 | 2462 | 2481 | 91732 | 91751 | AGGTGATGTTTCATTGGGTT | 16 | 1336 |
| 874306 | 2766 | 2785 | 113075 | 113094 | TGTGCTCCGTGTTACTAAGT | 71 | 1337 |
| 874329 | 3491 | 3510 | 136964 | 136983 | TGTCTCCTTGTTGTATGGTA | 49 | 1338 |
| 874352 | 4191 | 4210 | 148942 | 148961 | TATTTTAAAAACAAAATAAA | 88 | 1339 |
| 874376 | 4351 | 4370 | 149102 | 149121 | TTTCGGCAAGCAGAGCTGGG | 100 | 1340 |
| 874399 | 4520 | 4539 | 149271 | 149290 | AAGAATTTACTGAAACTTTG | 54 | 1341 |
| 874423 | 4658 | 4677 | 149409 | 149428 | TTTAAATTTTTTTTAAGTTT | 103 | 1342 |
| 874471 | N/A | N/A | 3562 | 3581 | CACATGGAGCCCCACGATTT | 102 | 1343 |
| 874495 | N/A | N/A | 3082 | 3101 | TGCTGCGGGAGGCTGGACAG | 121 | 1344 |
| 874519 | N/A | N/A | 6400 | 6419 | AATAATTACACTGAAGCAAA | 60 | 1345 |
| 874543 | N/A | N/A | 8244 | 8263 | TCCTTTAAGTCAAAATATAT | 81 | 1346 |
| 874567 | N/A | N/A | 10956 | 10975 | AAAAAAAACAGGCCTGTTAG | 103 | 1347 |
| 874591 | N/A | N/A | 14654 | 14673 | AGAGGCTAAAGCAGGAGGAC | 39 | 1348 |
| 874615 | N/A | N/A | 17664 | 17683 | CCTAGCTTAGATATAACCTC | 42 | 1349 |
| 874639 | N/A | N/A | 19930 | 19949 | GCATCATTACGACCATTCTG | 16 | 1350 |
| 874663 | N/A | N/A | 22432 | 22451 | AATCATATGTTCACACAAAA | 73 | 1351 |
| 874687 | N/A | N/A | 26823 | 26842 | AATAACATTTTTAATACCA | 80 | 1352 |
| 874711 | N/A | N/A | 29958 | 29977 | CATGGCTTAAAGCTCAGAAT | 119 | 1353 |
| 874735 | N/A | N/A | 31839 | 31858 | CTTGGTCATGAAGCCATGAA | 81 | 1354 |
| 874759 | N/A | N/A | 32915 | 32934 | ACTTAAGTAACTAATATTTA | 95 | 1355 |
| 874783 | N/A | N/A | 36363 | 36382 | GGAACCCCGAGTCGGGCAA | 94 | 1356 |

TABLE 19-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 874807 | N/A | N/A | 37726 | 37745 | ATTACTAGTGTATCTGTCAT | 47 | 1357 |
| 874831 | N/A | N/A | 40160 | 40179 | AAACCTCCGTCTCAAAGAAA | 89 | 1358 |
| 874855 | N/A | N/A | 42417 | 42436 | GCTAGGACTACAGGTACGCG | 87 | 1359 |
| 874879 | N/A | N/A | 44193 | 44212 | AAATTCCTGAAGTCTAAGGA | 148 | 1360 |
| 874903 | N/A | N/A | 45566 | 45585 | ATGCACTGCTTGCCTGGAGA | 40 | 1361 |
| 874927 | N/A | N/A | 46912 | 46931 | GCAATGAAACTGTTCTATTA | 61 | 1362 |
| 874951 | N/A | N/A | 49059 | 49078 | TCCATCATTTAAAAATCCTC | 37 | 1363 |
| 874975 | N/A | N/A | 51367 | 51386 | AGTAATAAAAATTTAATGAC | 70 | 1364 |
| 874999 | N/A | N/A | 54561 | 54580 | GTTAGCATCAAGAACTTAAA | 30 | 1365 |
| 875023 | N/A | N/A | 56886 | 56905 | TCAAGTGCAGCAATAAAGAC | 78 | 1366 |
| 875047 | N/A | N/A | 58785 | 58804 | TTTTATGCTAGAGGTTTTTA | 92 | 1367 |
| 875071 | N/A | N/A | 61109 | 61128 | ACAATAAAATAAAAATAAAC | 71 | 1368 |
| 875095 | N/A | N/A | 63285 | 63304 | AGATAAAAGGCACTGCAATT | 147 | 1369 |
| 875119 | N/A | N/A | 65276 | 65295 | GAAAAAAAAAATCTACAGTG | 95 | 1370 |
| 875143 | N/A | N/A | 68890 | 68909 | CTGACAAGCAGGAAGAAAGA | 83 | 1371 |
| 875167 | N/A | N/A | 71122 | 71141 | CGTGTATAGCTGGGAGCGGT | 84 | 1372 |
| 875191 | N/A | N/A | 72378 | 72397 | AAAGAATATTAATTTTCCAT | 83 | 1373 |
| 875215 | N/A | N/A | 74178 | 74197 | CCAGCAAATTTAAGCATGGA | 82 | 1374 |
| 875239 | N/A | N/A | 76560 | 76579 | CTCACTACAATAACAACAAC | 98 | 1375 |
| 875263 | N/A | N/A | 78033 | 78052 | GCTTGGAAAGCTGAGGCAGT | 98 | 1376 |
| 875287 | N/A | N/A | 80668 | 80687 | GAAAATGAAGCTTGTTTTTC | 137 | 1377 |
| 875311 | N/A | N/A | 82443 | 82462 | CAATGCCCCAGGGTTTATTC | 80 | 1378 |
| 875335 | N/A | N/A | 84195 | 84214 | CTTTCCAAATTTAAATAGCT | 133 | 1379 |
| 875359 | N/A | N/A | 85140 | 85159 | TTTTAGCATAACTTAACTGA | 133 | 1380 |
| 875383 | N/A | N/A | 87736 | 87755 | CATGATAAAATATTTTTAAC | 97 | 1381 |
| 875407 | N/A | N/A | 90262 | 90281 | AATCATGTTATTCTCAAAAT | 73 | 1382 |
| 875431 | N/A | N/A | 92462 | 92481 | ACACCAGAGTCCAGTACATC | 80 | 1383 |
| 875455 | N/A | N/A | 95328 | 95347 | ATTTTAAAAACCACTGATTT | 73 | 1384 |
| 875479 | N/A | N/A | 97386 | 97405 | AACAAGCATGTGAAGATAAT | 106 | 1385 |
| 875503 | N/A | N/A | 99111 | 99130 | CTCCTGCCTCAGTCTTGCGA | 96 | 1386 |
| 875527 | N/A | N/A | 101077 | 101096 | AATGATTTAAAATAATTTTA | 166 | 1387 |
| 875551 | N/A | N/A | 104161 | 104180 | AACCGAATTCAGTAACACAT | 59 | 1388 |
| 875575 | N/A | N/A | 108060 | 108079 | CAGGAAGAATAAAAAATGAA | 95 | 1389 |
| 875599 | N/A | N/A | 110294 | 110313 | TGCAATTCCTGGACAAGTCA | 69 | 1390 |
| 875623 | N/A | N/A | 112683 | 112702 | CACAGTCACCAAAGCACTCA | 142 | 1391 |
| 875647 | N/A | N/A | 115093 | 115112 | GCCCAAGATCACATCTAATT | 85 | 1392 |

TABLE 19-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 875671 | N/A | N/A | 117483 | 117502 | ATAACTGTAGGTATATATAA | 134 | 1393 |
| 875695 | N/A | N/A | 120698 | 120717 | ACAGATAAATTGAACTTCAT | 94 | 1394 |
| 875719 | N/A | N/A | 123938 | 123957 | TACTAAAAGTAGTAACTTTA | 82 | 1395 |
| 875743 | N/A | N/A | 127331 | 127350 | AGGCTGAGGTAGAAAGATAA | 128 | 1396 |
| 875767 | N/A | N/A | 129897 | 129916 | CTCCTTCTGGTAAACAAAAA | 108 | 1397 |
| 875791 | N/A | N/A | 131573 | 131592 | CACACTGGAAGAGACAAACA | 106 | 1398 |
| 875815 | N/A | N/A | 133419 | 133438 | CCGTTAAGACAACTAAAGAC | 101 | 1399 |
| 875839 | N/A | N/A | 135123 | 135142 | AGGTTTTTGACAAAAGCCCT | 104 | 1400 |
| 875863 | N/A | N/A | 137991 | 138010 | TCTCCATGAAGGAGCAACTA | 92 | 1401 |
| 875887 | N/A | N/A | 139982 | 140001 | AGACAAAAAAGGAACCAGGG | 106 | 1402 |
| 875911 | N/A | N/A | 142611 | 142630 | TTCCTTCATATCCAGTTTAG | 114 | 1403 |
| 875935 | N/A | N/A | 144712 | 144731 | GACGGAGTTTCACAGTGTTC | 87 | 1404 |
| 875959 | N/A | N/A | 146275 | 146294 | ACACCTTTCACCTGTAGCAG | 45 | 1405 |
| 875983 | N/A | N/A | 148054 | 148073 | AGCACTGGCCCTGCCTGCCA | 115 | 1406 |

TABLE 20

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 41 | 32 |
| 874166 | 168 | 187 | 2158 | 2177 | GAGGAGCTGCGGCCGCTGAG | 110 | 1407 |
| 874190 | 368 | 387 | 2358 | 2377 | GTCTGAGGCGGAGGGAGGCG | 91 | 1408 |
| 874214 | 995 | 1014 | 48694 | 48713 | CACTTGTACTTCACATTTGG | 62 | 1409 |
| 874235 | 1535 | 1554 | 81695 | 81714 | ATCATCATTTTCCAGGGCCA | 71 | 1410 |
| 874259 | 1763 | 1782 | 83374 | 83393 | ACCAGAATTCGGGTTGAAAT | 60 | 1411 |
| 874283 | 2464 | 2483 | 91734 | 91753 | CTAGGTGATGTTTCATTGGG | 30 | 1412 |
| 874307 | 2768 | 2787 | 113077 | 113096 | CTTGTGCTCCGTGTTACTAA | 37 | 1413 |
| 874330 | 3493 | 3512 | 136966 | 136985 | CTTGTCTCCTTGTTGTATGG | 45 | 1414 |
| 874353 | 4196 | 4215 | 148947 | 148966 | ATATATATTTTAAAAACAAA | 123 | 1415 |
| 874377 | 4356 | 4375 | 149107 | 149126 | TCCAGTTTCGGCAAGCAGAG | 52 | 1416 |
| 874400 | 4525 | 4544 | 149276 | 149295 | ACGGTAAGAATTTACTGAAA | 90 | 1417 |
| 874424 | 4671 | 4690 | 149422 | 149441 | ACTTTTTTTATTTTTTAAAT | 95 | 1418 |
| 874472 | N/A | N/A | 3567 | 3586 | GAGGCCACATGGAGCCCCAC | 97 | 1419 |
| 874496 | N/A | N/A | 3396 | 3415 | TCCGGAGGAGCCCGGTGCCT | 70 | 1420 |
| 874520 | N/A | N/A | 6521 | 6540 | TTCTTGACACTGGAAGTAAT | 70 | 1421 |

TABLE 20-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 874544 | N/A | N/A | 8253 | 8272 | TTGAGATCCTCCTTTAAGTC | 41 | 1422 |
| 874568 | N/A | N/A | 11322 | 11341 | GCCAAAATCAAGGTTACAAA | 36 | 1423 |
| 874592 | N/A | N/A | 14673 | 14692 | ATAAAGAACTCTCCAGACCA | 90 | 1424 |
| 874616 | N/A | N/A | 17714 | 17733 | ATTCAAATTTAACTGAGTGT | 85 | 1425 |
| 874640 | N/A | N/A | 20042 | 20061 | GCATTGGCCTACTCCGTGAA | 45 | 1426 |
| 874664 | N/A | N/A | 22447 | 22466 | AACCAAGAGAAATAAAATCA | 107 | 1427 |
| 874688 | N/A | N/A | 26863 | 26882 | GCTAGTGACTCAAGTTCCTG | 56 | 1428 |
| 874712 | N/A | N/A | 30034 | 30053 | AGTTAATGGGAAACATGATC | 84 | 1429 |
| 874736 | N/A | N/A | 31851 | 31870 | AGGGATAAAAGGCTTGGTCA | 72 | 1430 |
| 874760 | N/A | N/A | 32983 | 33002 | TGAAAGAAGCCTTCTCAAAC | 93 | 1431 |
| 874784 | N/A | N/A | 36387 | 36406 | ATTTTTGACAAGCTGACCGT | 103 | 1432 |
| 874808 | N/A | N/A | 37739 | 37758 | GATCTGTATTATAATTACTA | 79 | 1433 |
| 874832 | N/A | N/A | 40698 | 40717 | CGCCCTGACTCACGCCTGTA | 99 | 1434 |
| 874856 | N/A | N/A | 42555 | 42574 | ATCCAGAATGCAGTAAATGC | 27 | 1435 |
| 874880 | N/A | N/A | 44286 | 44305 | AAACAATGGACTTGAATTAA | 68 | 1436 |
| 874904 | N/A | N/A | 45671 | 45690 | ATTTCCAAACTTAAAATATA | 76 | 1437 |
| 874928 | N/A | N/A | 46982 | 47001 | GATGGAAGACAAATCAATGG | 71 | 1438 |
| 874952 | N/A | N/A | 49152 | 49171 | AGCTCATCAAGGTACCAGTT | 20 | 1439 |
| 874976 | N/A | N/A | 51385 | 51404 | GAAATGAAGATCTAATAAAG | 127 | 1440 |
| 875000 | N/A | N/A | 54588 | 54607 | CTTTTAAACTTTATTGAAAT | 85 | 1441 |
| 875024 | N/A | N/A | 56983 | 57002 | TGAAGGAAAAGAAGCCCAGG | 83 | 1442 |
| 875048 | N/A | N/A | 59243 | 59262 | ATTTTTAGTAGAGCCATGTC | 65 | 1443 |
| 875072 | N/A | N/A | 61124 | 61143 | AATTTCTTTAAAAATACAAT | 91 | 1444 |
| 875096 | N/A | N/A | 63309 | 63328 | TAGTTTGACTAAGCCCATTA | 53 | 1445 |
| 875120 | N/A | N/A | 65378 | 65397 | ACCACACTTATTTTCTATTT | 48 | 1446 |
| 875144 | N/A | N/A | 68973 | 68992 | TCCAAGGTCATCAATGCCCT | 106 | 1447 |
| 875168 | N/A | N/A | 71142 | 71161 | CTGGAGTGGCATTAAAAATA | 85 | 1448 |
| 875192 | N/A | N/A | 72380 | 72399 | TCAAAGAATATTAATTTTCC | 64 | 1449 |
| 875216 | N/A | N/A | 74198 | 74217 | GCCAAAATAAGAAATCTGAG | 55 | 1450 |
| 875240 | N/A | N/A | 76565 | 76584 | ATACACTCACTACAATAACA | 81 | 1451 |
| 875264 | N/A | N/A | 78448 | 78467 | TTGCAGTGTGACAGAGCAAG | 80 | 1452 |
| 875288 | N/A | N/A | 80812 | 80831 | ATCAAAGACAAATGCACTAA | 103 | 1453 |
| 875312 | N/A | N/A | 82491 | 82510 | TTGAACTATTTCAGTGCACT | 79 | 1454 |
| 875336 | N/A | N/A | 84211 | 84230 | CTCTATTTTCATCTAACTTT | 52 | 1455 |
| 875360 | N/A | N/A | 85184 | 85203 | GTACATTTTAACCCTTTGAG | 24 | 1456 |
| 875384 | N/A | N/A | 87737 | 87756 | ACATGATAAAATATTTTTAA | 144 | 1457 |

TABLE 20-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 875408 | N/A | N/A | 90294 | 90313 | CTCCAAAACTATGCTTATAC | 60 | 1458 |
| 875432 | N/A | N/A | 92496 | 92515 | TGTGTACAAAGTATAAATCT | 72 | 1459 |
| 875456 | N/A | N/A | 95417 | 95436 | CGACTGCTAAACTGGGCACG | 70 | 1460 |
| 875480 | N/A | N/A | 97390 | 97409 | TTCCAACAAGCATGTGAAGA | 116 | 1461 |
| 875504 | N/A | N/A | 99262 | 99281 | TCCTCTCTGCACTATACTAA | 90 | 1462 |
| 875528 | N/A | N/A | 101138 | 101157 | AATTTAGAAAGAACGAATAA | 92 | 1463 |
| 875552 | N/A | N/A | 104251 | 104270 | TACAAAACCAAAGGACACAT | 102 | 1464 |
| 875576 | N/A | N/A | 108123 | 108142 | AGAAAAATACAGAATATTGT | 100 | 1465 |
| 875600 | N/A | N/A | 110667 | 110686 | GGCACTATGGTCTGTAATCC | 73 | 1466 |
| 875624 | N/A | N/A | 112840 | 112859 | ATATCTTAAATAACTTTAGT | 89 | 1467 |
| 875648 | N/A | N/A | 115157 | 115176 | ATAAACCTGACAGCCTAGCT | 85 | 1468 |
| 875672 | N/A | N/A | 117704 | 117723 | GGCTAAGATTTCTATTTTTT | 62 | 1469 |
| 875696 | N/A | N/A | 120718 | 120737 | AGCAACAAAAGAAAAACAA | 86 | 1470 |
| 875720 | N/A | N/A | 124032 | 124051 | GGCTCTTCAAAAAAAACCGC | 96 | 1471 |
| 875744 | N/A | N/A | 127393 | 127412 | CTGGGTGTGATGGCTCATCC | 106 | 1472 |
| 875768 | N/A | N/A | 129900 | 129919 | CACCTCCTTCTGGTAAACAA | 87 | 1473 |
| 875792 | N/A | N/A | 131617 | 131636 | TAGATAGAGTATGTTTTCAG | 52 | 1474 |
| 875816 | N/A | N/A | 133430 | 133449 | ATATTCAGTCCCCGTTAAGA | 68 | 1475 |
| 875840 | N/A | N/A | 136211 | 136230 | GGTAAAAGCATCACCATAAA | 43 | 1476 |
| 875864 | N/A | N/A | 137994 | 138013 | CTTTCTCCATGAAGGAGCAA | 157 | 1477 |
| 875888 | N/A | N/A | 140040 | 140059 | AAGCAGGGTAGGAAGAAAAT | 106 | 1478 |
| 875912 | N/A | N/A | 142660 | 142679 | TCTAGGATCACCTGTGCATC | 60 | 1479 |
| 875936 | N/A | N/A | 144926 | 144945 | TCAACATGTATCTTAAATGT | 79 | 1480 |
| 875960 | N/A | N/A | 146301 | 146320 | AGACAGCAACCACTGAGATG | 93 | 1481 |
| 875984 | N/A | N/A | 148158 | 148177 | CTCGGCTCCCGGAAGCCTCA | 79 | 1482 |

TABLE 21

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 34 | 32 |
| 874167 | 173 | 192 | 2163 | 2182 | ACTCCGAGGAGCTGCGGCCG | 100 | 1483 |
| 874191 | 373 | 392 | 2363 | 2382 | AAACAGTCTGAGGCGGAGGG | 83 | 1484 |
| 874215 | 1077 | 1096 | 49251 | 49270 | TTTTCTCATGTGCGGCATCA | 49 | 1485 |

TABLE 21-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 874236 | 1536 | 1555 | 81696 | 81715 | TATCATCATTTTCCAGGGCC | 60 | 1486 |
| 874260 | 1764 | 1783 | 83375 | 83394 | AACCAGAATTCGGGTTGAAA | 58 | 1487 |
| 874284 | 2465 | 2484 | 91735 | 91754 | GCTAGGTGATGTTTCATTGG | 50 | 1488 |
| 874308 | 2806 | 2825 | 113115 | 113134 | GAAGTCTGAACCCCTTGGGA | 104 | 1489 |
| 874331 | 3940 | 3959 | 147855 | 147874 | ATTGGCGCATGGGCAGTTGG | 62 | 1490 |
| 874354 | 4201 | 4220 | 148952 | 148971 | TCAACATATATATTTTAAAA | 104 | 1491 |
| 874378 | 4361 | 4380 | 149112 | 149131 | TAACTTCCAGTTTCGGCAAG | 47 | 1492 |
| 874401 | 4530 | 4549 | 149281 | 149300 | GTTTGACGGTAAGAATTTAC | 86 | 1493 |
| 874425 | 4679 | 4698 | 149430 | 149449 | TTTTTAAAACTTTTTTTATT | 87 | 1494 |
| 874473 | N/A | N/A | 3572 | 3591 | TGCCGGAGGCCACATGGAGC | 93 | 1495 |
| 874497 | N/A | N/A | 3410 | 3429 | CAGACCCTGATGATTCCGGA | 56 | 1496 |
| 874521 | N/A | N/A | 6751 | 6770 | AACCAAGTACCCTCATTAAT | 110 | 1497 |
| 874545 | N/A | N/A | 8481 | 8500 | CCGCACTCATTGCAACCTCC | 100 | 1498 |
| 874569 | N/A | N/A | 11435 | 11454 | CAAAATAAATAAATAACCAA | 90 | 1499 |
| 874593 | N/A | N/A | 14692 | 14711 | AAAAGTTCTCAAAGAGGCCA | 72 | 1500 |
| 874617 | N/A | N/A | 17725 | 17744 | GTTCATCAAAAATTCAAATT | 140 | 1501 |
| 874641 | N/A | N/A | 20069 | 20088 | ATGAACTCCTGCTGCCTGGG | 55 | 1502 |
| 874665 | N/A | N/A | 22469 | 22488 | CAATCTCATTTCTATGCATT | 53 | 1503 |
| 874689 | N/A | N/A | 27130 | 27149 | CCTGGGTTTAAGTGACCCTC | 88 | 1504 |
| 874713 | N/A | N/A | 30201 | 30220 | TTAGTTTCATGGAAAATTTG | 78 | 1505 |
| 874737 | N/A | N/A | 31871 | 31890 | CCTTGAGTCCCTCTAGAGAA | 81 | 1506 |
| 874761 | N/A | N/A | 32994 | 33013 | ATGTCACCTCCTGAAAGAAG | 54 | 1507 |
| 874785 | N/A | N/A | 36430 | 36449 | TCATTTATTCTGCTTTGCT | 34 | 1508 |
| 874809 | N/A | N/A | 37849 | 37868 | AATAATACTTAATCCTACTC | 87 | 1509 |
| 874833 | N/A | N/A | 40743 | 40762 | AGAAACCATAATTAATGCA | 99 | 1510 |
| 874857 | N/A | N/A | 42595 | 42614 | GAATATATTAACTGATACCA | 50 | 1511 |
| 874881 | N/A | N/A | 44316 | 44335 | ACTTTTCCTCACTTTCTTCT | 95 | 1512 |
| 874905 | N/A | N/A | 45694 | 45713 | ACAGGCTAAATAAGCTGAAA | 93 | 1513 |
| 874929 | N/A | N/A | 47002 | 47021 | GGAAGGACACAAACCGTAAG | 62 | 1514 |
| 874953 | N/A | N/A | 49157 | 49176 | TCTTTAGCTCATCAAGGTAC | 75 | 1515 |
| 874977 | N/A | N/A | 51885 | 51904 | GTTTTGAAATAAGATACCTG | 78 | 1516 |
| 875001 | N/A | N/A | 54602 | 54621 | ATGCATGAATATAACTTTTA | 68 | 1517 |
| 875025 | N/A | N/A | 57059 | 57078 | AGCTGGCAGTGTGTGTCATG | 79 | 1518 |
| 875049 | N/A | N/A | 59277 | 59296 | CAGGTGCCCGTCACCTCGCC | 87 | 1519 |
| 875073 | N/A | N/A | 61226 | 61245 | TGTTTTGCAACTCCCTCAGT | 93 | 1520 |
| 875097 | N/A | N/A | 63380 | 63399 | GTGAGAGGTACAAATTGGAT | 58 | 1521 |

TABLE 21-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 875121 | N/A | N/A | 65409 | 65428 | ACAATATTTGCCTTGGTGGA | 74 | 1522 |
| 875145 | N/A | N/A | 68996 | 69015 | ATAAAGATGTAAATTTCTCT | 96 | 1523 |
| 875169 | N/A | N/A | 71146 | 71165 | TAGACTGGAGTGGCATTAAA | 103 | 1524 |
| 875193 | N/A | N/A | 72393 | 72412 | CCAATGCCATAAGTCAAAGA | 130 | 1525 |
| 875217 | N/A | N/A | 74384 | 74403 | CTCTGCTGAGGAATATAAGC | 129 | 1526 |
| 875241 | N/A | N/A | 76650 | 76669 | CCCCTACAAGTAAAATGACA | 122 | 1527 |
| 875265 | N/A | N/A | 78696 | 78715 | GGCAATAAGAATATGAACAG | 66 | 1528 |
| 875289 | N/A | N/A | 80842 | 80861 | ATTTATTCATCATAAATTAA | 103 | 1529 |
| 875313 | N/A | N/A | 82494 | 82513 | CAGTTGAACTATTTCAGTGC | 54 | 1530 |
| 875337 | N/A | N/A | 84223 | 84242 | AAACTTAGTGTTCTCTATTT | 88 | 1531 |
| 875361 | N/A | N/A | 85272 | 85291 | ATGATATGAAGGAAAGTATA | 84 | 1532 |
| 875385 | N/A | N/A | 87771 | 87790 | TTTGTAAAGAAATATGTTAC | 85 | 1533 |
| 875409 | N/A | N/A | 90317 | 90336 | CTATAATGCTATTCTGAGTG | 54 | 1534 |
| 875433 | N/A | N/A | 92571 | 92590 | AAGGAGAGATGTTAAGTAAA | 73 | 1535 |
| 875457 | N/A | N/A | 95441 | 95460 | GAAGGGCTGGAGGCAAATGT | 83 | 1536 |
| 875481 | N/A | N/A | 97406 | 97425 | TTTGTAGTCAACAGACTTCC | 89 | 1537 |
| 875505 | N/A | N/A | 99283 99341 | 99302 99360 | AATATAGCACTCTGCTGTAT | 109 | 1538 |
| 875529 | N/A | N/A | 101178 | 101197 | GGAGAAGAAGGGAAATGAGG | 87 | 1539 |
| 875553 | N/A | N/A | 104262 | 104281 | CTATTACCCTATACAAAACC | 82 | 1540 |
| 875577 | N/A | N/A | 108143 | 108162 | CTCACTGGTAACAAGTACAC | 66 | 1541 |
| 875601 | N/A | N/A | 110953 | 110972 | AAGGAAAAAGACACCAAAAA | 135 | 1542 |
| 875625 | N/A | N/A | 112860 | 112879 | AAGGAAACAATTATACTTAA | 83 | 1543 |
| 875649 | N/A | N/A | 115236 | 115255 | AGATTATCCTAACTATGTTT | 90 | 1544 |
| 875673 | N/A | N/A | 117770 | 117789 | TTTCAATTGATCCTCCCACC | 133 | 1545 |
| 875697 | N/A | N/A | 120786 | 120805 | TTCATAGGAGTAAATCTCTG | 53 | 1546 |
| 875721 | N/A | N/A | 124051 | 124070 | CATTAAAATTAACAATACTG | 128 | 1547 |
| 875745 | N/A | N/A | 127761 | 127780 | GTGGGAAAAAAATACAAGAC | 72 | 1548 |
| 875769 | N/A | N/A | 129981 | 130000 | GTTACATATTATTTTATCTA | 91 | 1549 |
| 875793 | N/A | N/A | 131634 | 131653 | AAAGGTCAGGTTATTCTTAG | 46 | 1550 |
| 875817 | N/A | N/A | 133534 | 133553 | CATAATGAACTTTTAACCTA | 65 | 1551 |
| 875841 | N/A | N/A | 136265 | 136284 | TCTTCCTAATGGCTCTAGTT | 60 | 1552 |
| 875865 | N/A | N/A | 138252 | 138271 | GGAACTCTTGTGCCTCCGCC | 87 | 1553 |
| 875889 | N/A | N/A | 140074 | 140093 | TTCCTTGATAGGCCAGTTAA | 72 | 1554 |
| 875913 | N/A | N/A | 142681 | 142700 | AGGGCAAGGCAAAGAGCCAG | 165 | 1555 |
| 875937 | N/A | N/A | 144941 | 144960 | CCAATCACCTTATTATCAAC | 60 | 1556 |

TABLE 21-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
| --- | --- | --- | --- | --- | --- | --- | --- |
| 875961 | N/A | N/A | 146302 | 146321 | CAGACAGCAACCACTGAGAT | 71 | 1557 |
| 875985 | N/A | N/A | 148184 | 148203 | CTGTATACCATCAGAACACA | 81 | 1558 |

TABLE 22

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
| --- | --- | --- | --- | --- | --- | --- | --- |
| 708199 | 1477 | 1496 | 81637 | 81656 | GCTAACTGGTTTGCCCTTGC | 33 | 32 |
| 874168 | 178 | 197 | 2168 | 2187 | GCGGGACTCCGAGGAGCTGC | 163 | 1559 |
| 874192 | 378 | 397 | 2368 | 2387 | TACCAAAACAGTCTGAGGCG | 74 | 1560 |
| 874216 | 1079 | 1098 | 49253 | 49272 | ACTTTTCTCATGTGCGGCAT | 31 | 1561 |
| 874237 | 1537 | 1556 | 81697 | 81716 | CTATCATCATTTTCCAGGGC | 42 | 1562 |
| 874261 | 1766 | 1785 | 83377 | 83396 | TGAACCAGAATTCGGGTTGA | 73 | 1563 |
| 874285 | 2466 | 2485 | 91736 | 91755 | AGCTAGGTGATGTTTCATTG | 62 | 1564 |
| 874309 | 2808 | 2827 | 113117 | 113136 | TGGAAGTCTGAACCCCTTGG | 68 | 1565 |
| 874332 | 3942 | 3961 | 147857 | 147876 | TCATTGGCGCATGGGCAGTT | 79 | 1566 |
| 874355 | 4206 | 4225 | 148957 | 148976 | AGAAATCAACATATATATTT | 67 | 1567 |
| 874379 | 4372 | 4391 | 149123 | 149142 | TAAAAAATAAATAACTTCCA | 106 | 1568 |
| 874402 | 4535 | 4554 | 149286 | 149305 | CGTCAGTTTGACGGTAAGAA | 81 | 1569 |
| 874426 | 4684 | 4703 | N/A | N/A | TTCAGTTTTTAAAACTTTTT | 79 | 1570 |
| 874474 | N/A | N/A | 3606 | 3625 | CCTTCCCTTCCCCAGGTGGG | 101 | 1571 |
| 874498 | N/A | N/A | 3852 | 3871 | CTCCTAGCATTTCCGAAATT | 88 | 1572 |
| 874522 | N/A | N/A | 6805 | 6824 | TTCCTCAGGAATTTCATTCC | 89 | 1573 |
| 874546 | N/A | N/A | 8491 | 8510 | ACTGCAACCTCCGCACTCAT | 97 | 1574 |
| 874570 | N/A | N/A | 11884 | 11903 | AAAAATTTTGCTGGGCATAG | 70 | 1575 |
| 874594 | N/A | N/A | 14775 | 14794 | ATCTGCCTCTGAAAACATTG | 51 | 1576 |
| 874618 | N/A | N/A | 17808 | 17827 | GATGCTCAGTTAAATTTCAA | 90 | 1577 |
| 874642 | N/A | N/A | 20074 | 20093 | ACTTCATGAACTCCTGCTGC | 73 | 1578 |
| 874666 | N/A | N/A | 22506 | 22525 | GTACCCTGGAAAAATAAACA | 88 | 1579 |
| 874690 | N/A | N/A | 27138 | 27157 | CTCCAATTCCTGGGTTTAAG | 89 | 1580 |
| 874714 | N/A | N/A | 30240 | 30259 | ACAAAGTTAAGTTCTACAGG | 62 | 1581 |
| 874738 | N/A | N/A | 31884 | 31903 | CAGTGCCTTTACCCCTTGAG | 22 | 1582 |
| 874762 | N/A | N/A | 33100 | 33119 | CATAAGGGTACCACATACCT | 66 | 1583 |
| 874786 | N/A | N/A | 36460 | 36479 | GTGTACATGTGATGGCAATA | 63 | 1584 |

TABLE 22-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 874810 | N/A | N/A | 37868 | 37887 | TCCAAGGCATTTTTTAAATA | 77 | 1585 |
| 874834 | N/A | N/A | 40754 | 40773 | TTAAGAACGAAAGAAAACCA | 121 | 1586 |
| 874858 | N/A | N/A | 42680 | 42699 | CACCTTCTGCTTCTGATGTG | 51 | 1587 |
| 874882 | N/A | N/A | 44355 | 44374 | CATTCTGAGGCCAGTCCTAG | 78 | 1588 |
| 874906 | N/A | N/A | 45805 | 45824 | CTACTAATTTTCCCCAATAA | 111 | 1589 |
| 874930 | N/A | N/A | 47049 | 47068 | TTGACTAAACATGACATAAA | 118 | 1590 |
| 874954 | N/A | N/A | 49184 | 49203 | CTTTACAAAATAAAATTTGT | 81 | 1591 |
| 874978 | N/A | N/A | 51901 | 51920 | CACTAAACCACTGTAAGTTT | 81 | 1592 |
| 875002 | N/A | N/A | 54673 | 54692 | GAGACCAAAGGAAACTTATT | 121 | 1593 |
| 875026 | N/A | N/A | 57092 | 57111 | TACACACATGATAGGAGGGA | 43 | 1594 |
| 875050 | N/A | N/A | 59367 | 59386 | AGTGCAGCACCACCATCTCG | 90 | 1595 |
| 875074 | N/A | N/A | 61380 | 61399 | GATAGTAAGTATATTAGCAT | 91 | 1596 |
| 875098 | N/A | N/A | 63430 | 63449 | TTTAAGTAATAAAAAGCAGT | 81 | 1597 |
| 875122 | N/A | N/A | 65449 | 65468 | AAATGAGAAATCTGGAAGAC | 76 | 1598 |
| 875146 | N/A | N/A | 69021 | 69040 | AAATTTCACTTGAAGGTTAG | 70 | 1599 |
| 875170 | N/A | N/A | 71153 | 71172 | TCCAACATAGACTGGAGTGG | 86 | 1600 |
| 875194 | N/A | N/A | 72435 | 72454 | TCTAATCTACAGGCAACTGT | 101 | 1601 |
| 875218 | N/A | N/A | 74386 | 74405 | GGCTCTGCTGAGGAATATAA | 145 | 1602 |
| 875242 | N/A | N/A | 76793 | 76812 | CTTATTTGGCTGGGTGTTAA | 70 | 1603 |
| 875266 | N/A | N/A | 79338 | 79357 | AACTACTATTAAGAGTTCTG | 66 | 1604 |
| 875290 | N/A | N/A | 80898 | 80917 | TTGGTAATAAGAGAAAAATT | 97 | 1605 |
| 875314 | N/A | N/A | 82601 | 82620 | AACTTGCTCCATGTTTCCTC | 51 | 1606 |
| 875338 | N/A | N/A | 84232 | 84251 | TGAAATTGGAAACTTAGTGT | 62 | 1607 |
| 875362 | N/A | N/A | 85722 | 85741 | GATAAACCCCCTTTTTAACA | 106 | 1608 |
| 875386 | N/A | N/A | 87885 | 87904 | TTATTATTTCCCTTTATTTT | 138 | 1609 |
| 875410 | N/A | N/A | 90318 | 90337 | TCTATAATGCTATTCTGAGT | 60 | 1610 |
| 875434 | N/A | N/A | 92599 | 92618 | TAACATGCAAAAGAATGAAA | 83 | 1611 |
| 875458 | N/A | N/A | 95478 | 95497 | GATTAACGGTTGCTTAGGGT | 10 | 1612 |
| 875482 | N/A | N/A | 97440 | 97459 | AGGACAATTCAGAGTCCAGT | 75 | 1613 |
| 875506 | N/A | N/A | 99284 99342 | 99303 99361 | GAATATAGCACTCTGCTGTA | 58 | 1614 |
| 875530 | N/A | N/A | 101219 | 101238 | GAGATAGCAGAATGGTTACC | 112 | 1615 |
| 875554 | N/A | N/A | 104868 | 104887 | AAAAAGTGGAAAAACTTCA | 88 | 1616 |
| 875578 | N/A | N/A | 108258 | 108277 | AGGCTGGTAACAGAGCATGA | 81 | 1617 |
| 875602 | N/A | N/A | 110997 | 111016 | AAAATTAGGTAAGCGATCAC | 72 | 1618 |
| 875626 | N/A | N/A | 112866 | 112885 | TAAATAAAGGAAACAATTAT | 111 | 1619 |
| 875650 | N/A | N/A | 115247 | 115266 | GTGTTCAGTATAGATTATCC | 28 | 1620 |

TABLE 22-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 875674 | N/A | N/A | 117793 | 117812 | TCCCTGCAGCCTGGACCTTC | 87 | 1621 |
| 875698 | N/A | N/A | 120810 | 120829 | AAATCATAGGAGTTTTATAG | 102 | 1622 |
| 875722 | N/A | N/A | 124664 | 124683 | CAAAGATCAATACAACAAAA | 91 | 1623 |
| 875746 | N/A | N/A | 127802 | 127821 | TTAAATATCAACACAGGGAT | 73 | 1624 |
| 875770 | N/A | N/A | 129995 | 130014 | ATTTGGGAGAGCTAGTTACA | 67 | 1625 |
| 875794 | N/A | N/A | 131763 | 131782 | TAGTTAAAGCAGGAAAGAGA | 108 | 1626 |
| 875818 | N/A | N/A | 133541 | 133560 | AAACAATCATAATGAACTTT | 112 | 1627 |
| 875842 | N/A | N/A | 136401 | 136420 | AAAATGTTAAAAGGCAGTTG | 69 | 1628 |
| 875866 | N/A | N/A | 138269 | 138288 | CCACCTCCAGGGTTCATGGA | 83 | 1629 |
| 875890 | N/A | N/A | 140774 | 140793 | TAATCTATAGCTAATTTGCA | 80 | 1630 |
| 875914 | N/A | N/A | 142798 | 142817 | TTAGGCTAGGCACATGGAGC | 33 | 1631 |
| 875938 | N/A | N/A | 144978 | 144997 | ATTTGATTTTTCATTACTGC | 57 | 1632 |
| 875962 | N/A | N/A | 146349 | 146368 | CAATCCCCTGGGCCCTGGAG | 127 | 1633 |
| 875986 | N/A | N/A | 148191 | 148210 | CCAAATCCTGTATACCATCA | 61 | 1634 |

TABLE 23

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 37 | 32 |
| 874169 | 183 | 202 | 2173 | 2192 | CCACCGCGGGACTCCGAGGA | 151 | 1635 |
| 874193 | 383 | 402 | 2373 | 2392 | GTTGCTACCAAAACAGTCTG | 94 | 1636 |
| 874217 | 1080 | 1099 | 49254 | 49273 | TACTTTTCTCATGTGCGGCA | 24 | 1637 |
| 874238 | 1539 | 1558 | 81699 | 81718 | TCCTATCATCATTTTCCAGG | 36 | 1638 |
| 874262 | 1767 | 1786 | 83378 | 83397 | CTGAACCAGAATTCGGGTTG | 100 | 1639 |
| 874286 | 2468 | 2487 | 91738 | 91757 | GAAGCTAGGTGATGTTTCAT | 89 | 1640 |
| 874310 | 2809 | 2828 | 113118 | 113137 | CTGGAAGTCTGAACCCCTTG | 70 | 1641 |
| 874333 | 3943 | 3962 | 147858 | 147877 | ATCATTGGCGCATGGGCAGT | 65 | 1642 |
| 874356 | 4211 | 4230 | 148962 | 148981 | TTACAAGAAATCAACATATA | 110 | 1643 |
| 874380 | 4377 | 4396 | 149128 | 149147 | GTTATTAAAAAATAAATAAC | 110 | 1644 |
| 874403 | 4540 | 4559 | 149291 | 149310 | TAATCCGTCAGTTTGACGGT | 80 | 1645 |
| 874427 | 4689 | 4708 | N/A | N/A | TTTTTTTCAGTTTTTAAAAC | 91 | 1646 |
| 874475 | N/A | N/A | 3611 | 3630 | CCACCCCTTCCCTTCCCCAG | 103 | 1647 |
| 874499 | N/A | N/A | 3916 | 3935 | CGCTAGTAAACACCCGCCTT | 69 | 1648 |

TABLE 23-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 874523 | N/A | N/A | 7056 | 7075 | CCTGTATCCCAAGCAATTCT | 51 | 1649 |
| 874547 | N/A | N/A | 8814 | 8833 | TTACATCTCCGTTGAAGTTG | 28 | 1650 |
| 874571 | N/A | N/A | 11970 | 11989 | ATGAGAATCATTTGAACGCA | 36 | 1651 |
| 874595 | N/A | N/A | 14959 | 14978 | TTTCTGTTTTTCAGTAGAGA | 70 | 1652 |
| 874619 | N/A | N/A | 17836 | 17855 | TAGACTGGAGTTGCCAGATA | 87 | 1653 |
| 874643 | N/A | N/A | 20097 | 20116 | CGTCTGGTCCCTGTTCAACA | 36 | 1654 |
| 874667 | N/A | N/A | 23044 | 23063 | ATCACCGAAAAAATTTCTCA | 111 | 1655 |
| 874691 | N/A | N/A | 27274 | 27293 | CTAAATTCCCTGAATTCCGT | 74 | 1656 |
| 874715 | N/A | N/A | 30281 | 30300 | ATAGTAAGCTACTACTGAAT | 82 | 1657 |
| 874739 | N/A | N/A | 32055 | 32074 | TACAGTTCCAGTTACTTGGG | 54 | 1658 |
| 874763 | N/A | N/A | 33174 | 33193 | TATAATCAAAATATTTCATT | 84 | 1659 |
| 874787 | N/A | N/A | 36472 | 36491 | CGTATTTTACTAGTGTACAT | 67 | 1660 |
| 874811 | N/A | N/A | 37919 | 37938 | TTAATTGGAGACTATAAGTG | 110 | 1661 |
| 874835 | N/A | N/A | 40848 | 40867 | ACCCACTGGAAAAAGAAGTA | 126 | 1662 |
| 874859 | N/A | N/A | 42797 | 42816 | TAAATCAAACAAGAATGGTA | 88 | 1663 |
| 874883 | N/A | N/A | 44372 | 44391 | TAGAAGAGTACTCTTAACAT | 103 | 1664 |
| 874907 | N/A | N/A | 45893 | 45912 | TTAAACAGTCAAGTTATCTA | 70 | 1665 |
| 874931 | N/A | N/A | 47058 | 47077 | AATGGTGTTTTGACTAAACA | 75 | 1666 |
| 874955 | N/A | N/A | 49371 | 49390 | CACCTCTTTTTGCATAACTG | 50 | 1667 |
| 874979 | N/A | N/A | 51931 | 51950 | ATACTACGCACTGGACGCAA | 97 | 1668 |
| 875003 | N/A | N/A | 54952 | 54971 | ATCAAGTAAAAAACAAGCAG | 82 | 1669 |
| 875027 | N/A | N/A | 57111 | 57130 | CATGGTATAAGGGCAATGAT | 102 | 1670 |
| 875051 | N/A | N/A | 59425 | 59444 | CATGTCCTATGCTTATTTTT | 105 | 1671 |
| 875075 | N/A | N/A | 61670 | 61689 | AATTCCAATTCTTACAGCTG | 57 | 1672 |
| 875099 | N/A | N/A | 63477 | 63496 | AGTGAGATAAAATAGAAAAA | 98 | 1673 |
| 875123 | N/A | N/A | 65509 | 65528 | GATGATCTAATAAAAGCAAT | 81 | 1674 |
| 875147 | N/A | N/A | 69082 | 69101 | ATAAATACTGCTAATACTAC | 94 | 1675 |
| 875171 | N/A | N/A | 71209 | 71228 | CTGATCTAGGCCTTCAAGAA | 109 | 1676 |
| 875195 | N/A | N/A | 72501 | 72520 | TGTTGGTAGTAAATAGTACA | 104 | 1677 |
| 875219 | N/A | N/A | 74397 | 74416 | TCTGCTGATCTGGCTCTGCT | 125 | 1678 |
| 875243 | N/A | N/A | 76838 | 76857 | CTCTAGGTGAAGTCAACAAT | 72 | 1679 |
| 875267 | N/A | N/A | 79378 | 79397 | AGTAAAAAGTAAATGTCTTC | 92 | 1680 |
| 875291 | N/A | N/A | 81016 | 81035 | ACAGCGAGATTCCCTCTCAA | 75 | 1681 |
| 875315 | N/A | N/A | 82626 | 82645 | AACGGAGTCACTGTTTTTCC | 45 | 1682 |
| 875339 | N/A | N/A | 84273 | 84292 | TTTGGAGAGGAATTCTGGAG | 120 | 1683 |
| 875363 | N/A | N/A | 85730 | 85749 | CAGGCAGAGATAAACCCCCT | 70 | 1684 |

TABLE 23-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 875387 | N/A | N/A | 88403 | 88422 | ATTTTTAACATATACATACT | 102 | 1685 |
| 875411 | N/A | N/A | 90320 | 90339 | AATCTATAATGCTATTCTGA | 78 | 1686 |
| 875435 | N/A | N/A | 92716 | 92735 | CCTTTAATTCAGCTACTTTT | 63 | 1687 |
| 875459 | N/A | N/A | 95503 | 95522 | AGCCCATCCATAGAGACAGA | 130 | 1688 |
| 875483 | N/A | N/A | 97464 | 97483 | GGATAAGACATAGAGATTCA | 82 | 1689 |
| 875507 | N/A | N/A | 99309 | 99328 | TTCTAATGCTATATTGCTAT | 129 | 1690 |
| 875531 | N/A | N/A | 101479 | 101498 | TACGGCACTATATACACAAC | 60 | 1691 |
| 875555 | N/A | N/A | 104920 | 104939 | TACAGTAAAAGCAACAATAA | 123 | 1692 |
| 875579 | N/A | N/A | 108451 | 108470 | TCACCCTGAGGTCAGGAGCT | 131 | 1693 |
| 875603 | N/A | N/A | 111034 | 111053 | CAACTATCCACACAAGAAAG | 95 | 1694 |
| 875627 | N/A | N/A | 112878 | 112897 | CTTGGCTGTAACTAAATAAA | 81 | 1695 |
| 875651 | N/A | N/A | 115321 | 115340 | TTATTTATAATACCTAAAAC | 91 | 1696 |
| 875675 | N/A | N/A | 117891 | 117910 | CTCCCTAATTTTAATGCAGA | 75 | 1697 |
| 875699 | N/A | N/A | 120877 | 120896 | CTCATCTCATACACAAAAAT | 158 | 1698 |
| 875723 | N/A | N/A | 124851 | 124870 | TATTTCTCCCAGAACTGATA | 94 | 1699 |
| 875747 | N/A | N/A | 127963 | 127982 | CTCACTGACTACTCCTATCA | 90 | 1700 |
| 875771 | N/A | N/A | 130056 | 130075 | AAGAACTGATTATATAATTA | 82 | 1701 |
| 875795 | N/A | N/A | 131935 | 131954 | AAGTAGTGAAGCAAAATGTT | 68 | 1702 |
| 875819 | N/A | N/A | 133588 | 133607 | ATGTTCTTTCCACTTGTTAA | 68 | 1703 |
| 875843 | N/A | N/A | 136489 | 136508 | ACATGAATATTATTTCTTAT | 116 | 1704 |
| 875867 | N/A | N/A | 138357 | 138376 | CCTTATTTTTATTTTTATT | 138 | 1705 |
| 875891 | N/A | N/A | 140799 | 140818 | ATTTAAAGACTATAATACGG | 77 | 1706 |
| 875915 | N/A | N/A | 142869 | 142888 | GGTAGGCAAGGCTGCCGAGT | 83 | 1707 |
| 875939 | N/A | N/A | 145137 | 145156 | TACTGCCCCAGGGAACTGAT | 81 | 1708 |
| 875963 | N/A | N/A | 146696 | 146715 | AAAGCAAATCAACTGCAGTG | 72 | 1709 |
| 875987 | N/A | N/A | 148256 | 148275 | GAAGGCCAACTGAGTCCTAG | 77 | 1710 |

TABLE 24

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 31 | 32 |
| 708439 | 3944 | 3963 | 147859 | 147878 | CATCATTGGCGCATGGGCAG | 99 | 1711 |
| 874170 | 188 | 207 | 2178 | 2197 | GGTGGCCACCGCGGGACTCC | 87 | 1712 |
| 874194 | 397 | 416 | 2387 | 2406 | CCGCCGCCGTTGCCGTTGCT | 83 | 1713 |

TABLE 24-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 874218 | 1081 | 1100 | 49255 | 49274 | GTACTTTTCTCATGTGCGGC | 42 | 1714 |
| 874239 | 1540 | 1559 | 81700 | 81719 | CTCCTATCATCATTTTCCAG | 65 | 1715 |
| 874263 | 1768 | 1787 | 83379 | 83398 | TCTGAACCAGAATTCGGGTT | 92 | 1716 |
| 874287 | 2662 | 2681 | 112971 | 112990 | GCACTTGGTTCAATTTTGTC | 53 | 1717 |
| 874311 | 2810 | 2829 | 113119 | 113138 | GCTGGAAGTCTGAACCCCTT | 47 | 1718 |
| 874357 | 4216 | 4235 | 148967 | 148986 | GGATGTTACAAGAAATCAAC | 43 | 1719 |
| 874381 | 4382 | 4401 | 149133 | 149152 | CAAGGGTTATTAAAAAATAA | 85 | 1720 |
| 874404 | 4545 | 4564 | 149296 | 149315 | AATAATAATCCGTCAGTTTG | 117 | 1721 |
| 874476 | N/A | N/A | 3616 | 3635 | ACTCCCCACCCCTTCCCTTC | 84 | 1722 |
| 874500 | N/A | N/A | 3958 | 3977 | CCCCCAGCCCCTACTACAAC | 96 | 1723 |
| 874524 | N/A | N/A | 7091 | 7110 | ATCACTAAAAGAAAAATATT | 87 | 1724 |
| 874548 | N/A | N/A | 8823 | 8842 | ATAAACTGTTTACATCTCCG | 29 | 1725 |
| 874572 | N/A | N/A | 12217 | 12236 | AAGGCCATCCTGGGCAACAG | 79 | 1726 |
| 874596 | N/A | N/A | 15407 | 15426 | GAGTCTCACTCTGCTCTGTG | 64 | 1727 |
| 874620 | N/A | N/A | 17861 | 17880 | AAAACAGTGAACCATGATTC | 56 | 1728 |
| 874644 | N/A | N/A | 20157 | 20176 | TGCTCCCCAATGTCCACCG | 90 | 1729 |
| 874668 | N/A | N/A | 23193 | 23212 | TTATGTTACATCTGCCAACA | 60 | 1730 |
| 874692 | N/A | N/A | 27712 | 27731 | TTTTCTGAAATGTTTTATAT | 126 | 1731 |
| 874716 | N/A | N/A | 30303 | 30322 | AATCTTTTTATTCTTGTAAT | 54 | 1732 |
| 874740 | N/A | N/A | 32095 | 32114 | AGAAAGTTTTAAAAATTAGG | 82 | 1733 |
| 874764 | N/A | N/A | 33231 | 33250 | TGTCCTTCAGTAGTTTCTAA | 38 | 1734 |
| 874788 | N/A | N/A | 36528 | 36547 | TTTAAGTAATGCTTTATATT | 126 | 1735 |
| 874812 | N/A | N/A | 37937 | 37956 | TGTTTAAGTAAAATGTTTTT | 119 | 1736 |
| 874836 | N/A | N/A | 40941 | 40960 | TGAGGTATCCAGAGTTACTA | 45 | 1737 |
| 874860 | N/A | N/A | 42836 | 42855 | AAATAATAATAATACAGAAG | 90 | 1738 |
| 874884 | N/A | N/A | 44389 | 44408 | CACGACTGGTCGATCCCTAG | 51 | 1739 |
| 874908 | N/A | N/A | 45927 | 45946 | TCATTAAAAAAACACATATA | 99 | 1740 |
| 874932 | N/A | N/A | 47502 | 47521 | CTAATAACTTACAACAACTG | 102 | 1741 |
| 874956 | N/A | N/A | 49373 | 49392 | CCCACCTCTTTTTGCATAAC | 85 | 1742 |
| 874980 | N/A | N/A | 52015 | 52034 | TATAGAAGAGGGCAATTTCT | 86 | 1743 |
| 875004 | N/A | N/A | 54998 | 55017 | GAAGGAAAAAAATAGAGGAG | 89 | 1744 |
| 875028 | N/A | N/A | 57198 | 57217 | AATAATAAAGACAGTATCAC | 86 | 1745 |
| 875052 | N/A | N/A | 59519 | 59538 | AATAATTCCATTCAAAGTAT | 81 | 1746 |
| 875076 | N/A | N/A | 61682 | 61701 | TAAAATGAAATTAATTCCAA | 117 | 1747 |
| 875100 | N/A | N/A | 63482 | 63501 | GATAAAGTGAGATAAAATAG | 103 | 1748 |
| 875124 | N/A | N/A | 66333 | 66352 | TAAATCCAGGAGTAAAAGAA | 81 | 1749 |

TABLE 24-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 875148 | N/A | N/A | 69107 | 69126 | ACTGAGTTCTATAGGTGCTT | 31 | 1750 |
| 875172 | N/A | N/A | 71274 | 71293 | CAAAGTTCTAAGGAACAAAA | 113 | 1751 |
| 875196 | N/A | N/A | 72792 | 72811 | GCAAGATCTGGGTATCCATT | 40 | 1752 |
| 875220 | N/A | N/A | 74536 | 74555 | CTCTAGTTGGGAGTTAGACT | 109 | 1753 |
| 875244 | N/A | N/A | 76866 | 76885 | GGCTTAAAATGTCCTACTTC | 90 | 1754 |
| 875268 | N/A | N/A | 79384 | 79403 | ACATCCAGTAAAAAGTAAAT | 78 | 1755 |
| 875292 | N/A | N/A | 81142 | 81161 | ATGGGCATGGTAGCACGCGC | 80 | 1756 |
| 875316 | N/A | N/A | 82640 | 82659 | CAATTAGCTGCACAAACGGA | 104 | 1757 |
| 875340 | N/A | N/A | 84332 | 84351 | CAGTGAGCAAAGAAATTTCA | 118 | 1758 |
| 875364 | N/A | N/A | 85737 | 85756 | TAATTATCAGGCAGAGATAA | 79 | 1759 |
| 875388 | N/A | N/A | 88525 | 88544 | ACACTTTACTCACTGCGAAA | 41 | 1760 |
| 875412 | N/A | N/A | 90352 | 90371 | AACTGCCATTTTTCCAATTA | 49 | 1761 |
| 875436 | N/A | N/A | 92751 | 92770 | TGAGGAAAGGCTACCTTTGC | 87 | 1762 |
| 875460 | N/A | N/A | 95519 | 95538 | GAATTTGCCCCAAATAAGCC | 85 | 1763 |
| 875484 | N/A | N/A | 97532 | 97551 | GCTAACTGAAAAAGTACAGC | 89 | 1764 |
| 875508 | N/A | N/A | 99312 | 99331 | TTGTTCTAATGCTATATTGC | 36 | 1765 |
| 875532 | N/A | N/A | 101681 | 101700 | GCTGGTAACGATGTGGATAA | 52 | 1766 |
| 875556 | N/A | N/A | 105449 | 105468 | AGTTAAAATCATATCAACTA | 94 | 1767 |
| 875580 | N/A | N/A | 108631 | 108650 | AAAGTGGAAAAATTCAATTG | 117 | 1768 |
| 875604 | N/A | N/A | 111039 | 111058 | TTGAACAACTATCCACACAA | 119 | 1769 |
| 875628 | N/A | N/A | 113298 | 113317 | TAAGGGCAATGTATAAAGTA | 82 | 1770 |
| 875652 | N/A | N/A | 115440 | 115459 | GTTACAGTACCCTGTGAAGA | 75 | 1771 |
| 875676 | N/A | N/A | 118364 | 118383 | AAAATGAAAACTTTATGTCA | 87 | 1772 |
| 875700 | N/A | N/A | 120891 | 120910 | CCTGGACCACTACTCTCATC | 77 | 1773 |
| 875724 | N/A | N/A | 124961 | 124980 | AGCAGGCACAAAACTGATAC | 58 | 1774 |
| 875748 | N/A | N/A | 128029 | 128048 | ACACACCAAAAAAATTAAGG | 97 | 1775 |
| 875772 | N/A | N/A | 130077 | 130096 | AGAACTTGTTCATAAAATCC | 57 | 1776 |
| 875796 | N/A | N/A | 131945 | 131964 | CCCTCAGATCAAGTAGTGAA | 69 | 1777 |
| 875820 | N/A | N/A | 133661 | 133680 | GCAATGGAAATTTTAGCTTA | 39 | 1778 |
| 875844 | N/A | N/A | 136534 | 136553 | ATCTAGTAATGGATCCAAAA | 80 | 1779 |
| 875868 | N/A | N/A | 138482 | 138501 | AATCCTTAATATCCTCTAGA | 48 | 1780 |
| 875892 | N/A | N/A | 140856 | 140875 | TGAAATATTTTTACTATGCA | 57 | 1781 |
| 875916 | N/A | N/A | 142990 | 143009 | ATTCCAAAATAGTTCCCCAC | 79 | 1782 |
| 875940 | N/A | N/A | 145153 | 145172 | TAAAGTCAAAAAAGACTACT | 115 | 1783 |

TABLE 24-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 875964 | N/A | N/A | 146768 | 146787 | CTCTTATGAAGCTGACTCCA | 82 | 1784 |
| 875988 | N/A | N/A | 148406 | 148425 | TACACTCAAAGCCAGTCCAT | 87 | 1785 |

TABLE 25

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 27 | 32 |
| 874171 | 193 | 212 | 2183 | 2202 | GACTCGGTGGCCACCGCGGG | 80 | 1786 |
| 874195 | 402 | 421 | 2392 | 2411 | ACGCGCCGCCGCCGTTGCCG | 92 | 1787 |
| 874219 | 1083 | 1102 | 49257 | 49276 | CTGTACTTTTCTCATGTGCG | 44 | 1788 |
| 874240 | 1541 | 1560 | 81701 | 81720 | ACTCCTATCATCATTTTCCA | 85 | 1789 |
| 874264 | 1770 | 1789 | 83381 | 83400 | GGTCTGAACCAGAATTCGGG | 59 | 1790 |
| 874288 | 2664 | 2683 | 112973 | 112992 | TAGCACTTGGTTCAATTTTG | 26 | 1791 |
| 874312 | 2812 | 2831 | 113121 | 113140 | GGGCTGGAAGTCTGAACCCC | 120 | 1792 |
| 874334 | 3946 | 3965 | 147861 | 147880 | AGCATCATTGGCGCATGGGC | 24 | 1793 |
| 874358 | 4230 | 4249 | 148981 | 149000 | TTAGCATTCCTATTGGATGT | 70 | 1794 |
| 874382 | 4387 | 4406 | 149138 | 149157 | ACTTTCAAGGGTTATTAAAA | 54 | 1795 |
| 874405 | 4556 | 4575 | 149307 | 149326 | CTTGATTTATAAATAATAAT | 90 | 1796 |
| 874477 | N/A | N/A | 3621 | 3640 | CGGGCACTCCCCACCCCTTC | 71 | 1797 |
| 874501 | N/A | N/A | 4095 | 4114 | CGTTTCCTTCTCCCTTTGAA | 20 | 1798 |
| 874525 | N/A | N/A | 7401 | 7420 | TAGGCCCTTCTACAAGATAT | 79 | 1799 |
| 874549 | N/A | N/A | 9003 | 9022 | TGGTGGTGTGCGCATGTAGA | 47 | 1800 |
| 874573 | N/A | N/A | 12222 | 12241 | AATTCAAGGCCATCCTGGGC | 73 | 1801 |
| 874597 | N/A | N/A | 15438 | 15457 | TCTTCCAAACTTTTTTTTTT | 48 | 1802 |
| 874621 | N/A | N/A | 18178 | 18197 | GAAGAGTGAACCATGGCCAG | 69 | 1803 |
| 874645 | N/A | N/A | 20304 | 20323 | AGCAACCCGACCACAGCTGG | 86 | 1804 |
| 874669 | N/A | N/A | 23253 | 23272 | GCTGTATTTTTACTCACCTT | 18 | 1805 |
| 874693 | N/A | N/A | 27825 | 27844 | AATGTTCATCTTTTCACATC | 42 | 1806 |
| 874717 | N/A | N/A | 30442 | 30461 | TCATAATCTCAAATGCAAGC | 39 | 1807 |
| 874741 | N/A | N/A | 32163 | 32182 | CTGGGAGGCCAAGGTGAGTC | 71 | 1808 |
| 874765 | N/A | N/A | 33310 | 33329 | ATAATTATAGAGCTTCATGT | 42 | 1809 |
| 874789 | N/A | N/A | 36607 | 36626 | AACTGCTGGATAGCATTAAA | 73 | 1810 |
| 874813 | N/A | N/A | 37953 | 37972 | TAAAAGTCTAAAATTATGTT | 85 | 1811 |

TABLE 25-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 874837 | N/A | N/A | 41033 | 41052 | GGGAAGAAGGATAGAACACT | 53 | 1812 |
| 874861 | N/A | N/A | 42880 | 42899 | GCATTGGTGACAGAGCAAAA | 81 | 1813 |
| 874885 | N/A | N/A | 44413 | 44432 | ATTCAGATCCAAAAAGTCTA | 107 | 1814 |
| 874909 | N/A | N/A | 45945 | 45964 | TGTACATTTTATACAGAGTC | 38 | 1815 |
| 874933 | N/A | N/A | 47521 | 47540 | GCAGTTTATCCCCAATAATC | 35 | 1816 |
| 874957 | N/A | N/A | 49426 | 49445 | ATCTTTGCTTGAATAAATCT | 66 | 1817 |
| 874981 | N/A | N/A | 52019 | 52038 | CTTTTATAGAAGAGGGCAAT | 76 | 1818 |
| 875005 | N/A | N/A | 55002 | 55021 | AAATGAAGGAAAAAAATAGA | 85 | 1819 |
| 875029 | N/A | N/A | 57201 | 57220 | ATAAATAATAAAGACAGTAT | 112 | 1820 |
| 875053 | N/A | N/A | 59564 | 59583 | TCTTTAGAGATTTATTTGAG | 67 | 1821 |
| 875077 | N/A | N/A | 61729 | 61748 | TCAAACCTATGGCAAAAGTG | 71 | 1822 |
| 875101 | N/A | N/A | 63615 | 63634 | TTATGGTGAGCTACGATGGC | 72 | 1823 |
| 875125 | N/A | N/A | 66398 | 66417 | GTGGGCTTGGTTTTGAAAAA | 67 | 1824 |
| 875149 | N/A | N/A | 69151 | 69170 | AATAATAATTTGAGATACCC | 77 | 1825 |
| 875173 | N/A | N/A | 71317 | 71336 | CTTTTAGAATCGAATACAAT | 83 | 1826 |
| 875197 | N/A | N/A | 72817 | 72836 | CATTGCATCATTAGCTAGAA | 67 | 1827 |
| 875221 | N/A | N/A | 74550 | 74569 | GCACAGGAAATTTTCTCTAG | 54 | 1828 |
| 875245 | N/A | N/A | 76887 | 76906 | CAACCTTTTCTTCAGACAAG | 120 | 1829 |
| 875269 | N/A | N/A | 79445 | 79464 | TTACTTAAGTAATGTATGCC | 105 | 1830 |
| 875293 | N/A | N/A | 81388 | 81407 | TTCTGTTACCTTTTCTCCAG | 60 | 1831 |
| 875317 | N/A | N/A | 82821 | 82840 | ACCTCAAACTGAACCGCCAG | 73 | 1832 |
| 875341 | N/A | N/A | 84407 | 84426 | GTATCATATATTTCTCAGCC | 23 | 1833 |
| 875365 | N/A | N/A | 85746 | 85765 | AAAGAAGCATAATTATCAGG | 65 | 1834 |
| 875389 | N/A | N/A | 88528 | 88547 | TTAACACTTTACTCACTGCG | 33 | 1835 |
| 875413 | N/A | N/A | 90523 | 90542 | GTTTGTATCCCATATGACTT | 42 | 1836 |
| 875437 | N/A | N/A | 92768 | 92787 | AAAGCTAAAACACAGGCTGA | 79 | 1837 |
| 875461 | N/A | N/A | 95659 | 95678 | TCAAGGAATATTAGTCAGTC | 70 | 1838 |
| 875485 | N/A | N/A | 97621 | 97640 | AAGACTTTTTATGTTGCTCC | 15 | 1839 |
| 875509 | N/A | N/A | 99383 | 99402 | TATTGCCATCTTACAAATAG | 100 | 1840 |
| 875533 | N/A | N/A | 102082 | 102101 | TGGTGGCAGGAGGCAGGAGA | 72 | 1841 |
| 875557 | N/A | N/A | 105635 | 105654 | ATGTGACGGCATGTGCCTGT | 141 | 1842 |
| 875581 | N/A | N/A | 108635 | 108654 | TCCCAAAGTGGAAAAATTCA | 83 | 1843 |
| 875605 | N/A | N/A | 111085 | 111104 | GCCAAACAGAACCTTCCAGT | 81 | 1844 |
| 875629 | N/A | N/A | 113410 | 113429 | CTTGTTTTTCTAGCCCTGGG | 82 | 1845 |
| 875653 | N/A | N/A | 115560 | 115579 | CAGCTATTTTTAAGAAACTG | 74 | 1846 |
| 875677 | N/A | N/A | 118824 | 118843 | TTCCAAGGCTAAAAAAAAAA | 116 | 1847 |

TABLE 25-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 875701 | N/A | N/A | 120923 | 120942 | GGACAACGGATATCCACAAG | 86 | 1848 |
| 875725 | N/A | N/A | 125020 | 125039 | TTAAAATATAACTCACAACA | 87 | 1849 |
| 875749 | N/A | N/A | 128050 | 128069 | ATCATCAATGGCTGCTAAAA | 51 | 1850 |
| 875773 | N/A | N/A | 130117 | 130136 | GAATGACTGCTTACAACTAG | 50 | 1851 |
| 875797 | N/A | N/A | 131959 | 131978 | TGTAATGCCAGTGACCCTCA | 54 | 1852 |
| 875821 | N/A | N/A | 133854 | 133873 | TGAAAATCATCTGTACCTCA | 58 | 1853 |
| 875845 | N/A | N/A | 136627 | 136646 | GTACCAAAATAAAACTATTT | 81 | 1854 |
| 875869 | N/A | N/A | 138721 | 138740 | TTTCCTAGCACCAAATAAAT | 85 | 1855 |
| 875893 | N/A | N/A | 141020 | 141039 | TTTGAAATTTCACTTTTAAA | 86 | 1856 |
| 875917 | N/A | N/A | 143008 | 143027 | AGCCCATACACAGAAATGAT | 77 | 1857 |
| 875941 | N/A | N/A | 145161 | 145180 | ATACATACTAAAGTCAAAAA | 79 | 1858 |
| 875965 | N/A | N/A | 146830 | 146849 | TACATGTAAGTTCACATGCC | 129 | 1859 |
| 875989 | N/A | N/A | 148687 | 148706 | ATTCGCTTTTCCCCCTCCCA | 75 | 1860 |

TABLE 26

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708152 | 1085 | 1104 | 49259 | 49278 | TTCTGTACTTTTCTCATGTG | 50 | 1861 |
| 708199 | 1477 | 1496 | 81637 | 81656 | GCTAACTGGTTTGCCCTTGC | 31 | 32 |
| 874172 | 198 | 217 | 2188 | 2207 | GGCGAGACTCGGTGGCCACC | 90 | 1862 |
| 874196 | 407 | 426 | 2397 | 2416 | CCGAAACGCGCCGCCGCCGT | 88 | 1863 |
| 874241 | 1553 | 1572 | 81713 | 81732 | TTTTTCTTCCTCACTCCTAT | 70 | 1864 |
| 874265 | 1800 | 1819 | N/A | N/A | GCCAGGGAACACCTCCATTA | 80 | 1865 |
| 874289 | 2665 | 2684 | 112974 | 112993 | TTAGCACTTGGTTCAATTTT | 55 | 1866 |
| 874313 | 2813 | 2832 | 113122 | 113141 | TGGGCTGGAAGTCTGAACCC | 88 | 1867 |
| 874335 | 3947 | 3966 | 147862 | 147881 | TAGCATCATTGGCGCATGGG | 29 | 1868 |
| 874359 | 4235 | 4254 | 148986 | 149005 | AACTGTTAGCATTCCTATTG | 32 | 1869 |
| 874383 | 4392 | 4411 | 149143 | 149162 | TCATGACTTTCAAGGGTTAT | 46 | 1870 |
| 874406 | 4561 | 4580 | 149312 | 149331 | TCAAACTTGATTTATAAATA | 94 | 1871 |
| 874478 | N/A | N/A | 3644 | 3663 | AAGGAGGAAGGCCGGGACGG | 90 | 1872 |
| 874502 | N/A | N/A | 4159 | 4178 | TGGTAAGCTCTGGCGGCACT | 50 | 1873 |
| 874526 | N/A | N/A | 7402 | 7421 | TTAGGCCCTTCTACAAGATA | 59 | 1874 |
| 874550 | N/A | N/A | 9185 | 9204 | AAAAACACAAGTACTTTCAT | 78 | 1875 |
| 874574 | N/A | N/A | 12346 | 12365 | AAGATCCTGCAACACACACA | 62 | 1876 |

TABLE 26-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 874598 | N/A | N/A | 15441 | 15460 | CAGTCTTCCAAACTTTTTT | 47 | 1877 |
| 874622 | N/A | N/A | 18202 | 18221 | CATAGAGCTTAAATTTTAGT | 57 | 1878 |
| 874646 | N/A | N/A | 20308 | 20327 | CCCCAGCAACCCGACCACAG | 94 | 1879 |
| 874670 | N/A | N/A | 23345 | 23364 | ACTGATAAATGACTCATCCC | 48 | 1880 |
| 874694 | N/A | N/A | 27838 | 27857 | ATTACCTAAATAAAATGTTC | 88 | 1881 |
| 874718 | N/A | N/A | 30485 | 30504 | TAATTGTAAAGTCCCTGCTC | 115 | 1882 |
| 874742 | N/A | N/A | 32207 | 32226 | AAAAAAGGCCAGTCGCAGTG | 73 | 1883 |
| 874766 | N/A | N/A | 33314 | 33333 | CAATATAATTATAGAGCTTC | 48 | 1884 |
| 874790 | N/A | N/A | 36647 | 36666 | GCATAAGACACCATGCCTAG | 89 | 1885 |
| 874814 | N/A | N/A | 38116 | 38135 | TCATGTCTCTCATATGTTTA | 67 | 1886 |
| 874838 | N/A | N/A | 41106 | 41125 | TAGAGTGATGGTAGGCATAC | 64 | 1887 |
| 874862 | N/A | N/A | 42969 | 42988 | CCCCGCTACTTGGTAGGGTG | 89 | 1888 |
| 874886 | N/A | N/A | 44472 | 44491 | TTTTAATAAAATAATCACAA | 90 | 1889 |
| 874910 | N/A | N/A | 46039 | 46058 | GCATGAGTCAATTAAACCTC | 39 | 1890 |
| 874934 | N/A | N/A | 47558 | 47577 | TTTTAACTTCATGGAATTAC | 72 | 1891 |
| 874958 | N/A | N/A | 49453 | 49472 | AAAAAAGTTTGTAAGATCAC | 87 | 1892 |
| 874982 | N/A | N/A | 52064 | 52083 | TGGTTTTCTCCATACTGATA | 43 | 1893 |
| 875006 | N/A | N/A | 55055 | 55074 | GTTGGAGTAAAGAGGAAAAC | 88 | 1894 |
| 875030 | N/A | N/A | 57279 | 57298 | GGCACTGAATTTCATTTATT | 43 | 1895 |
| 875054 | N/A | N/A | 59820 | 59839 | CGGCTGGAGTGCAATCTCAG | 82 | 1896 |
| 875078 | N/A | N/A | 61798 | 61817 | ACAGAATTTAGGAATTGAAA | 91 | 1897 |
| 875102 | N/A | N/A | 63893 | 63912 | AAAATGTAAATTGATTGTAG | 111 | 1898 |
| 875126 | N/A | N/A | 66456 | 66475 | AATAAAAACAAACCACAATG | 100 | 1899 |
| 875150 | N/A | N/A | 69170 | 69189 | CAAAAATATATATACATAAA | 103 | 1900 |
| 875174 | N/A | N/A | 71392 | 71411 | ATACAATTCCCAGCATTTCC | 78 | 1901 |
| 875198 | N/A | N/A | 72868 | 72887 | CATCAGGATGCTGAGAAAAT | 90 | 1902 |
| 875222 | N/A | N/A | 74610 | 74629 | AGTACTGACTTATGAAAGCA | 85 | 1903 |
| 875246 | N/A | N/A | 76925 | 76944 | CTTTAATTCCAATGTAACCT | 42 | 1904 |
| 875270 | N/A | N/A | 79474 | 79493 | AATCACACTTACTTATGGAG | 75 | 1905 |
| 875294 | N/A | N/A | 81536 | 81555 | TTTAAAGCCACAGTTTATGT | 49 | 1906 |
| 875318 | N/A | N/A | 82842 | 82861 | AATATCGGCAATGCTGATGA | 84 | 1907 |
| 875342 | N/A | N/A | 84409 | 84428 | AAGTATCATATATTTCTCAG | 50 | 1908 |
| 875366 | N/A | N/A | 85841 | 85860 | TTCAAGACTGGCTGAAGAAA | 86 | 1909 |
| 875390 | N/A | N/A | 88618 | 88637 | ACAAAACTTTATAGTTTTAC | 99 | 1910 |
| 875414 | N/A | N/A | 90912 | 90931 | GGAATTTGCTGGCAATCAAA | 31 | 1911 |
| 875438 | N/A | N/A | 92803 | 92822 | AATAAGTCAAGAATGAAGCT | 79 | 1912 |

TABLE 26-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 875462 | N/A | N/A | 95679 | 95698 | AAAATGTGGTATTATCCACA | 119 | 1913 |
| 875486 | N/A | N/A | 97661 | 97680 | AGGCACCTAAAAGTAGTAAG | 45 | 1914 |
| 875510 | N/A | N/A | 99409 | 99428 | ACAGCCCTATTTGATGTAGA | 48 | 1915 |
| 875534 | N/A | N/A | 102327 | 102346 | AATATAAAAGGCACTCAAGC | 95 | 1916 |
| 875558 | N/A | N/A | 105640 | 105659 | GCCATATGTGACGGCATGTG | 92 | 1917 |
| 875582 | N/A | N/A | 108837 | 108856 | CCTCACCAAATGAACTAAAA | 105 | 1918 |
| 875606 | N/A | N/A | 111160 | 111179 | ATATTGGTCAGTTAGACATT | 85 | 1919 |
| 875630 | N/A | N/A | 113616 | 113635 | ACATTAACTAAAACACAGTT | 76 | 1920 |
| 875654 | N/A | N/A | 115601 | 115620 | AACTTAAAACTTTGTCAATT | 97 | 1921 |
| 875678 | N/A | N/A | 118878 | 118897 | CTCTATAATTTGATTACATT | 70 | 1922 |
| 875702 | N/A | N/A | 120942 | 120961 | TTTTCAACAAATGAGGTGGG | 87 | 1923 |
| 875726 | N/A | N/A | 125029 | 125048 | TGAAAGTTTTTAAAATATAA | 93 | 1924 |
| 875750 | N/A | N/A | 128051 | 128070 | TATCATCAATGGCTGCTAAA | 57 | 1925 |
| 875774 | N/A | N/A | 130162 | 130181 | TTTCTGGTGTGGCATTAACC | 68 | 1926 |
| 875798 | N/A | N/A | 132162 | 132181 | TGCTTATTATTCTCACATAT | 22 | 1927 |
| 875822 | N/A | N/A | 133992 | 134011 | GTTCATTCCAGATTTCACTG | 34 | 1928 |
| 875846 | N/A | N/A | 136702 | 136721 | AGTAAAAGGAATAAAATCAT | 98 | 1929 |
| 875870 | N/A | N/A | 138751 | 138770 | AGAGCATCTATTAAAGGATT | 76 | 1930 |
| 875894 | N/A | N/A | 141087 | 141106 | CGGAATCTCAGAGGTTTTTG | 52 | 1931 |
| 875918 | N/A | N/A | 143022 | 143041 | CCCTCAAGATAATAAGCCCA | 87 | 1932 |
| 875942 | N/A | N/A | 145277 | 145296 | GTACAGGAGAATGTACAGGG | 83 | 1933 |
| 875966 | N/A | N/A | 146947 | 146966 | AATGCCGTTTTTACTCTCAC | 18 | 1934 |
| 875990 | N/A | N/A | 148704 | 148723 | ACAAAACTCAAAATTGAATT | 103 | 1935 |

TABLE 27

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708153 | 1087 | 1106 | 49261 | 49280 | GATTCTGTACTTTTCTCATG | 45 | 1936 |
| 708199 | 1477 | 1496 | 81637 | 81656 | GCTAACTGGTTTGCCCTTGC | 29 | 32 |
| 874173 | 203 | 222 | 2193 | 2212 | GAAGCGGCGAGACTCGGTGG | 96 | 1937 |
| 874197 | 412 | 431 | 2402 | 2421 | CCGGGCCGAAACGCGCCGCC | 109 | 1938 |
| 874242 | 1554 | 1573 | 81714 | 81733 | ATTTTTCTTCCTCACTCCTA | 64 | 1939 |
| 874266 | 2091 | 2110 | 88201 | 88220 | CAAATTCTAGGCCACTGGAT | 91 | 1940 |

TABLE 27-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 874290 | 2666 | 2685 | 112975 | 112994 | CTTAGCACTTGGTTCAATTT | 45 | 1941 |
| 874314 | 2814 | 2833 | 113123 | 113142 | CTGGGCTGGAAGTCTGAACC | 92 | 1942 |
| 874336 | 3948 | 3967 | 147863 | 147882 | TTAGCATCATTGGCGCATGG | 52 | 1943 |
| 874360 | 4240 | 4259 | 148991 | 149010 | AAGTGAACTGTTAGCATTCC | 34 | 1944 |
| 874384 | 4397 | 4416 | 149148 | 149167 | TGTGTTCATGACTTTCAAGG | 18 | 1945 |
| 874407 | 4566 | 4585 | 149317 | 149336 | CCTCATCAAACTTGATTTAT | 52 | 1946 |
| 874479 | N/A | N/A | 3666 | 3685 | CGCCGGAGAGGTCTGGCGGG | 91 | 1947 |
| 874503 | N/A | N/A | 4530 | 4549 | AAGTAGTGTTTGGGATGCTT | 12 | 1948 |
| 874527 | N/A | N/A | 7453 | 7472 | AAACCCCATGTACATAGATG | 71 | 1949 |
| 874551 | N/A | N/A | 9771 | 9790 | TTCGAGATGAGCCTAACCAA | 78 | 1950 |
| 874575 | N/A | N/A | 12824 | 12843 | TACTTAAAATGCATAAAAAA | 86 | 1951 |
| 874599 | N/A | N/A | 15653 | 15672 | TAAGTGAACCACCTGCCTCA | 98 | 1952 |
| 874623 | N/A | N/A | 18210 | 18229 | CCTGCTTTCATAGAGCTTAA | 65 | 1953 |
| 874647 | N/A | N/A | 20402 | 20421 | ATTTCTTCACCCGTAAATAG | 60 | 1954 |
| 874671 | N/A | N/A | 23871 | 23890 | CATTGGTCAACAGTTCACAA | 42 | 1955 |
| 874695 | N/A | N/A | 27880 | 27899 | CTAATAGGCACACAATAAAT | 61 | 1956 |
| 874719 | N/A | N/A | 30635 | 30654 | TTATTACTTGCCAGGCATTG | 40 | 1957 |
| 874743 | N/A | N/A | 32289 | 32308 | TATGTTATTAAGTGTTTAAT | 89 | 1958 |
| 874767 | N/A | N/A | 33325 | 33344 | CTGTCACCATACAATATAAT | 67 | 1959 |
| 874791 | N/A | N/A | 36798 | 36817 | CTGCTAGACAAATTCTGTAA | 77 | 1960 |
| 874815 | N/A | N/A | 38215 | 38234 | TTATTAATTTCCTTATTTTG | 91 | 1961 |
| 874839 | N/A | N/A | 41127 | 41146 | ATGCCAAAATCACTGTGATT | 87 | 1962 |
| 874863 | N/A | N/A | 43158 | 43177 | GTCAAATTAATATAAAGAAA | 95 | 1963 |
| 874887 | N/A | N/A | 44512 | 44531 | TCTCATAAACATTAGTCATG | 43 | 1964 |
| 874911 | N/A | N/A | 46136 | 46155 | CAGCACTTCTCTCTCCTGTC | 39 | 1965 |
| 874935 | N/A | N/A | 47663 | 47682 | AATGAATTATATTAGACTGG | 51 | 1966 |
| 874959 | N/A | N/A | 49459 | 49478 | TCTTTAAAAAAGTTTGTAA | 109 | 1967 |
| 874983 | N/A | N/A | 52103 | 52122 | AAAAAAAGAAGGAAACCATG | 98 | 1968 |
| 875007 | N/A | N/A | 55092 | 55111 | CAATGGAATAAGGAAACAGA | 102 | 1969 |
| 875031 | N/A | N/A | 57429 | 57448 | TTGTATTTCTCCGTACTGTC | 40 | 1970 |
| 875055 | N/A | N/A | 59830 | 59849 | TGGAGTCACCCGGCTGGAGT | 86 | 1971 |
| 875079 | N/A | N/A | 61810 | 61829 | AAGAATCAAAAACAGAATT | 95 | 1972 |
| 875103 | N/A | N/A | 63905 | 63924 | TTCAGGGTGATGAAAATGTA | 82 | 1973 |
| 875127 | N/A | N/A | 66510 | 66529 | CATACAAACATAAATTAATT | 112 | 1974 |
| 875151 | N/A | N/A | 69174 | 69193 | ATCTCAAAAATATATATACA | 102 | 1975 |
| 875175 | N/A | N/A | 71435 | 71454 | TGCACTCATAAGTCTGGACG | 79 | 1976 |

TABLE 27-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 875199 | N/A | N/A | 72897 | 72916 | TGGAGAGTTAGCACGAAATG | 106 | 1977 |
| 875223 | N/A | N/A | 74624 | 74643 | TAATGTTATTGAAGAGTACT | 107 | 1978 |
| 875247 | N/A | N/A | 76941 | 76960 | AGAAATTTATGTAATGCTTT | 80 | 1979 |
| 875271 | N/A | N/A | 79484 | 79503 | ATGGGCAGGAAATCACACTT | 79 | 1980 |
| 875295 | N/A | N/A | 81537 | 81556 | CTTTAAAGCCACAGTTTATG | 89 | 1981 |
| 875319 | N/A | N/A | 82852 | 82871 | TCATGGCTCCAATATCGGCA | 16 | 1982 |
| 875343 | N/A | N/A | 84424 | 84443 | GGGTTCCACACACTTAAGTA | 49 | 1983 |
| 875367 | N/A | N/A | 85857 | 85876 | GTAAAATGAACCTAAGTTCA | 77 | 1984 |
| 875391 | N/A | N/A | 88635 | 88654 | TATTAGAGAGGTACTTTACA | 84 | 1985 |
| 875415 | N/A | N/A | 90965 | 90984 | CCTCTCTAGCCCTTACCCTT | 84 | 1986 |
| 875439 | N/A | N/A | 92861 | 92880 | AGCTGAATAGATACATGTGC | 75 | 1987 |
| 875463 | N/A | N/A | 95779 | 95798 | ACGAGAAAAAAACTGCACAC | 95 | 1988 |
| 875487 | N/A | N/A | 97686 | 97705 | GGCTAAATAATACATTTGGT | 54 | 1989 |
| 875511 | N/A | N/A | 99731 | 99750 | GGTCTGACTCCGTTGCCCAG | 84 | 1990 |
| 875535 | N/A | N/A | 102493 | 102512 | ATACCCCAAAAGTACAGGCA | 97 | 1991 |
| 875559 | N/A | N/A | 105649 | 105668 | AAAATATCAGCCATATGTGA | 95 | 1992 |
| 875583 | N/A | N/A | 108869 | 108888 | CACAAGCATCAAGGCCATCT | 85 | 1993 |
| 875607 | N/A | N/A | 111262 | 111281 | TTAGGATGTGGAGGGACCGT | 85 | 1994 |
| 875631 | N/A | N/A | 113671 | 113690 | TCCATTTAATTAATATACTG | 79 | 1995 |
| 875655 | N/A | N/A | 115613 | 115632 | TGTTTCAGTAGGAACTTAAA | 84 | 1996 |
| 875679 | N/A | N/A | 118886 | 118905 | AGATTAAACTCTATAATTTG | 93 | 1997 |
| 875703 | N/A | N/A | 121448 | 121467 | ATTTGTCAAAACTCATTAAA | 73 | 1998 |
| 875727 | N/A | N/A | 125164 | 125183 | CAACATGGTGATTAGATCAT | 73 | 1999 |
| 875751 | N/A | N/A | 128148 | 128167 | AGAAATATTCCAGGCAATAA | 74 | 2000 |
| 875775 | N/A | N/A | 130284 | 130303 | GAATTCAGCTCAACTGTCAT | 91 | 2001 |
| 875799 | N/A | N/A | 132176 | 132195 | AAGATGGGTTTTTTGCTTA | 21 | 2002 |
| 875823 | N/A | N/A | 134012 | 134031 | AGAACCGGCTCTAATGACTA | 72 | 2003 |
| 875847 | N/A | N/A | 136768 | 136787 | GGACTAAACCGGAAGACACT | 64 | 2004 |
| 875871 | N/A | N/A | 138796 | 138815 | GTTTCCCCTTTAATAGTATA | 48 | 2005 |
| 875895 | N/A | N/A | 141093 | 141112 | ACAGTACGGAATCTCAGAGG | 35 | 2006 |
| 875919 | N/A | N/A | 143144 | 143163 | GACAGCACACCGATGATAAA | 85 | 2007 |
| 875943 | N/A | N/A | 145320 | 145339 | CTAAGCTTTGCACACTTGGG | 80 | 2008 |
| 875967 | N/A | N/A | 146952 | 146971 | GATGAAATGCCGTTTTTACT | 39 | 2009 |
| 875991 | N/A | N/A | 148739 | 148758 | AGCACATGATTGTAAACTAT | 35 | 2010 |

TABLE 28

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 29 | 32 |
| 874174 | 208 | 227 | 2198 | 2217 | GCGGCGAAGCGGCGAGACTC | 107 | 2011 |
| 874198 | 428 | 447 | 2418 | 2437 | AAGGAGCCGCCGGGAGCCGG | 87 | 2012 |
| 874220 | 1105 | 1124 | 49279 | 49298 | CGTTTCGGCCCCGAACTGGA | 51 | 2013 |
| 874243 | 1555 | 1574 | 81715 | 81734 | TATTTTTCTTCCTCACTCCT | 70 | 2014 |
| 874267 | 2093 | 2112 | 88203 | 88222 | TACAAATTCTAGGCCACTGG | 62 | 2015 |
| 874291 | 2668 | 2687 | 112977 | 112996 | TCCTTAGCACTTGGTTCAAT | 53 | 2016 |
| 874315 | 2816 | 2835 | 113125 | 113144 | TGCTGGGCTGGAAGTCTGAA | 88 | 2017 |
| 874337 | 3950 | 3969 | 147865 | 147884 | CATTAGCATCATTGGCGCAT | 81 | 2018 |
| 874361 | 4245 | 4264 | 148996 | 149015 | ACTGCAAGTGAACTGTTAGC | 87 | 2019 |
| 874385 | 4402 | 4421 | 149153 | 149172 | GCTGATGTGTTCATGACTTT | 35 | 2020 |
| 874408 | 4571 | 4590 | 149322 | 149341 | GATCACCTCATCAAACTTGA | 52 | 2021 |
| 874480 | N/A | N/A | 3671 | 3690 | CCGCGCGCCGGAGAGGTCTG | 90 | 2022 |
| 874504 | N/A | N/A | 4591 | 4610 | AAAGGGAAACTGAAGTTACC | 155 | 2023 |
| 874528 | N/A | N/A | 7600 | 7619 | CCTTTAATCTGCTTTCTTCT | 103 | 2024 |
| 874552 | N/A | N/A | 9851 | 9870 | GTAGGCTGCGCACGGTGGCT | 90 | 2025 |
| 874576 | N/A | N/A | 12944 | 12963 | AAACCAGGCCGGACGCGGTG | 146 | 2026 |
| 874600 | N/A | N/A | 15789 | 15808 | CTTGTGTCTGTTTTTTAGTA | 69 | 2027 |
| 874624 | N/A | N/A | 18211 | 18230 | TCCTGCTTTCATAGAGCTTA | 81 | 2028 |
| 874648 | N/A | N/A | 20415 | 20434 | CCTCTTGGTCTCAATTTCTT | 74 | 2029 |
| 874672 | N/A | N/A | 23931 | 23950 | GGTCAGAGGTTAAAAGTCTT | 79 | 2030 |
| 874696 | N/A | N/A | 27902 | 27921 | CTTGGCACAGCTCTCCTGAA | 126 | 2031 |
| 874720 | N/A | N/A | 30661 | 30680 | AAGAACAGCTAAAAGTTACT | 89 | 2032 |
| 874744 | N/A | N/A | 32321 | 32340 | ATACAGATCGCATAGCTTAA | 68 | 2033 |
| 874768 | N/A | N/A | 33334 | 33353 | CTATTGGTACTGTCACCATA | 82 | 2034 |
| 874792 | N/A | N/A | 36850 | 36869 | ATCAGTATTTACTACTTCTG | 34 | 2035 |
| 874816 | N/A | N/A | 38219 | 38238 | ACAATTATTAATTTCCTTAT | 114 | 2036 |
| 874840 | N/A | N/A | 41151 | 41170 | ACAGTCAGGAAAAGAGACAA | 96 | 2037 |
| 874864 | N/A | N/A | 43345 | 43364 | AAACCAAATATTTTACTATT | 89 | 2038 |
| 874888 | N/A | N/A | 44523 | 44542 | AATGTTATATTTCTCATAAA | 94 | 2039 |
| 874912 | N/A | N/A | 46218 | 46237 | GTTTCCCCTACGCTGCTCTC | 51 | 2040 |
| 874936 | N/A | N/A | 47696 | 47715 | CCCACAGATGCAGAGGACCA | 76 | 2041 |
| 874960 | N/A | N/A | 49471 | 49490 | AGCCCAGATATTTCTTTAAA | 99 | 2042 |
| 874984 | N/A | N/A | 52289 | 52308 | GTACTAAGAATACAAACAAA | 87 | 2043 |
| 875008 | N/A | N/A | 55163 | 55182 | TTTGCTGACCCCTATCATCT | 82 | 2044 |
| 875032 | N/A | N/A | 57470 | 57489 | ACAGTTTCACTAGGTTCTCA | 24 | 2045 |

TABLE 28-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 875056 | N/A | N/A | 59886 | 59905 | TTTCTACAAAAACGGATATA | 92 | 2046 |
| 875080 | N/A | N/A | 61853 | 61872 | CTGTAGAAGAACTAAGACAA | 81 | 2047 |
| 875104 | N/A | N/A | 64010 | 64029 | TGTCCAGAATGGGCAAACCT | 81 | 2048 |
| 875128 | N/A | N/A | 66875 | 66894 | TGTTTTAACTAAGAGTCAGC | 75 | 2049 |
| 875152 | N/A | N/A | 69497 | 69516 | GGCCAGAGCGGATACCATAT | 88 | 2050 |
| 875176 | N/A | N/A | 71472 | 71491 | TATTTAGTCATTTTTAGCAC | 87 | 2051 |
| 875200 | N/A | N/A | 72951 | 72970 | AAAAGTAGCTCTTTCTAAAG | 87 | 2052 |
| 875224 | N/A | N/A | 74662 | 74681 | ATTAACACACTCTCACTTTG | 64 | 2053 |
| 875248 | N/A | N/A | 76949 | 76968 | TAAGACCAAGAAATTTATGT | 104 | 2054 |
| 875272 | N/A | N/A | 79499 | 79518 | CCTTTTGCCAAACACATGGG | 90 | 2055 |
| 875296 | N/A | N/A | 81540 | 81559 | GTCCTTTAAAGCCACAGTTT | 99 | 2056 |
| 875320 | N/A | N/A | 82893 | 82912 | TTCTCTGAGATCTCTTCTCT | 98 | 2057 |
| 875344 | N/A | N/A | 84594 | 84613 | ACAGTTAAACACTTATCTAA | 88 | 2058 |
| 875368 | N/A | N/A | 85860 | 85879 | GCTGTAAAATGAACCTAAGT | 61 | 2059 |
| 875392 | N/A | N/A | 88725 | 88744 | ATGTTTATAGAATGTACTGA | 60 | 2060 |
| 875416 | N/A | N/A | 91284 | 91303 | CAGAAGCCCTTTGTTACATA | 40 | 2061 |
| 875440 | N/A | N/A | 92863 | 92882 | AAAGCTGAATAGATACATGT | 95 | 2062 |
| 875464 | N/A | N/A | 96003 | 96022 | ACACTTCACACCCACAAGGA | 95 | 2063 |
| 875488 | N/A | N/A | 97870 | 97889 | TAGGGTTTCGCCATGTTATC | 43 | 2064 |
| 875512 | N/A | N/A | 99818 | 99837 | ACTTTTGGTGTTGCTTTTTC | 40 | 2065 |
| 875536 | N/A | N/A | 102497 | 102516 | AGTAATACCCCAAAAGTACA | 151 | 2066 |
| 875560 | N/A | N/A | 105876 | 105895 | CAGCTATAGAATACACATTC | 93 | 2067 |
| 875584 | N/A | N/A | 109381 | 109400 | GATACCTCTACAGAGTCACA | 81 | 2068 |
| 875608 | N/A | N/A | 111328 | 111347 | GGCAGATTTATAGTTCAGAA | 46 | 2069 |
| 875632 | N/A | N/A | 113780 | 113799 | CCCCAATTTATCAATAAGCT | 85 | 2070 |
| 875656 | N/A | N/A | 115778 | 115797 | AAAAACAACAATAAATTCAA | 98 | 2071 |
| 875680 | N/A | N/A | 119028 | 119047 | AAGTTCCCATTGCATTGTTT | 21 | 2072 |
| 875704 | N/A | N/A | 121520 | 121539 | GGACAGAGAAGAGGAACAGG | 83 | 2073 |
| 875728 | N/A | N/A | 125171 | 125190 | AAAACACCAACATGGTGATT | 95 | 2074 |
| 875752 | N/A | N/A | 128189 | 128208 | AGGGTAACCAAACAGCTGGA | 59 | 2075 |
| 875776 | N/A | N/A | 130418 | 130437 | AGTATAACACAGCACCATGT | 78 | 2076 |
| 875800 | N/A | N/A | 132257 | 132276 | ACAGTGAAAAATCTATTATT | 92 | 2077 |
| 875824 | N/A | N/A | 134106 | 134125 | AGCCTGCCTCCATACAGACA | 91 | 2078 |
| 875848 | N/A | N/A | 136819 | 136838 | TCATAAGAGATGACAAGCAC | 66 | 2079 |
| 875872 | N/A | N/A | 138832 | 138851 | ACCTACTATCTTTTACACAC | 84 | 2080 |
| 875896 | N/A | N/A | 141120 | 141139 | ATTCTGTTCATGGAGGTTCA | 41 | 2081 |

TABLE 28-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 875920 | N/A | N/A | 143153 | 143172 | GTGACTATGGACAGCACACC | 77 | 2082 |
| 875944 | N/A | N/A | 145386 | 145405 | AAGCGACAGGAAAGAATTGA | 129 | 2083 |
| 875968 | N/A | N/A | 147009 | 147028 | GAGCCCTTGTTTCCTTTTTC | 109 | 2084 |
| 875992 | N/A | N/A | 148775 | 148794 | AACTGGCAACACCACACATC | 152 | 2085 |

TABLE 29

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 30 | 32 |
| 874175 | 213 | 232 | 2203 | 2222 | TGGCTGCGGCGAAGCGGCGA | 94 | 2086 |
| 874199 | 433 | 452 | 2423 | 2442 | AGACCAAGGAGCCGCCGGGA | 64 | 2087 |
| 874221 | 1125 | 1144 | 49299 | 49318 | TACTCTCCATTATTTCTTCA | 46 | 2088 |
| 874244 | 1557 | 1576 | 81717 | 81736 | TGTATTTTTCTTCCTCACTC | 38 | 2089 |
| 874268 | 2095 | 2114 | 88205 | 88224 | GATACAAATTCTAGGCCACT | 51 | 2090 |
| 874292 | 2669 | 2688 | 112978 | 112997 | ATCCTTAGCACTTGGTTCAA | 87 | 2091 |
| 874316 | 3123 | 3142 | 116359 | 116378 | CTTGATTCACTGGCATGGGC | 52 | 2092 |
| 874338 | 4093 | 4112 | 148844 | 148863 | GGGCAGCCTTACAACTGCTG | 88 | 2093 |
| 874362 | 4257 | 4276 | 149008 | 149027 | CAAGTATCTTCCACTGCAAG | 70 | 2094 |
| 874386 | 4407 | 4426 | 149158 | 149177 | TGCTAGCTGATGTGTTCATG | 66 | 2095 |
| 874409 | 4576 | 4595 | 149327 | 149346 | ACAGTGATCACCTCATCAAA | 83 | 2096 |
| 874433 | N/A | N/A | 146548 | 146567 | GCCAGAGCCTCACTGGCGCA | 122 | 2097 |
| 874481 | N/A | N/A | 3676 | 3695 | ACCACCCGCGCGCCGGAGAG | 89 | 2098 |
| 874505 | N/A | N/A | 4702 | 4721 | GAATTATCTGCCAAATCTCT | 56 | 2099 |
| 874529 | N/A | N/A | 7648 | 7667 | CCAATCCATTTAAAATTGTA | 83 | 2100 |
| 874553 | N/A | N/A | 9909 | 9928 | TTTAAGATTTAGGATTTTTT | 81 | 2101 |
| 874577 | N/A | N/A | 13311 | 13330 | CACAAATAATTACCAGCAAA | 62 | 2102 |
| 874601 | N/A | N/A | 15978 | 15997 | GACCAATATCTGTACTCCCA | 41 | 2103 |
| 874625 | N/A | N/A | 18215 | 18234 | AAGTTCCTGCTTTCATAGAG | 49 | 2104 |
| 874649 | N/A | N/A | 20447 | 20466 | GCAGCCAATGATGAGATACT | 43 | 2105 |
| 874673 | N/A | N/A | 24094 | 24113 | CGGGCCCGGCCCGCATGTTT | 83 | 2106 |
| 874697 | N/A | N/A | 27956 | 27975 | ACCAGCCTGACAGGCTGGGC | 106 | 2107 |
| 874721 | N/A | N/A | 30733 | 30752 | CCAAGCCCATCAATACCACT | 80 | 2108 |
| 874745 | N/A | N/A | 32329 | 32348 | AATATTCCATACAGATCGCA | 30 | 2109 |
| 874769 | N/A | N/A | 33336 | 33355 | CTCTATTGGTACTGTCACCA | 42 | 2110 |

TABLE 29-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 874793 | N/A | N/A | 36881 | 36900 | GAAAGATAAAGTTGTTTATT | 125 | 2111 |
| 874817 | N/A | N/A | 38303 | 38322 | TACTGGTTCTTGACCAGAAA | 91 | 2112 |
| 874841 | N/A | N/A | 41190 | 41209 | CAGCATCACCTAGTAATTAG | 47 | 2113 |
| 874865 | N/A | N/A | 43373 | 43392 | TTACTTTTAATCTTTTCATT | 79 | 2114 |
| 874889 | N/A | N/A | 44532 | 44551 | TTAAAGTGAAATGTTATATT | 99 | 2115 |
| 874913 | N/A | N/A | 46464 | 46483 | GCATAAAGAACTCTGCAGAC | 72 | 2116 |
| 874937 | N/A | N/A | 48095 | 48114 | AACCATGCCTCTTTTTCTC | 30 | 2117 |
| 874961 | N/A | N/A | 49914 | 49933 | TACAAACTAATTTTTTAAGA | 117 | 2118 |
| 874985 | N/A | N/A | 52437 | 52456 | TTGATTAAACCATACCTTCC | 136 | 2119 |
| 875009 | N/A | N/A | 55244 | 55263 | AGCCATCAAAACAGCCATAG | 65 | 2120 |
| 875033 | N/A | N/A | 57471 | 57490 | CACAGTTTCACTAGGTTCTC | 51 | 2121 |
| 875057 | N/A | N/A | 59915 | 59934 | TCTAATAAGCTTTAGAATCA | 78 | 2122 |
| 875081 | N/A | N/A | 61874 | 61893 | AGAAAAAAGAAGAAAATGAT | 96 | 2123 |
| 875105 | N/A | N/A | 64054 | 64073 | AGAAAAAAAAAGGCTATATA | 119 | 2124 |
| 875129 | N/A | N/A | 66933 | 66952 | GGAAAGTGGAGTAAGTAGGG | 68 | 2125 |
| 875153 | N/A | N/A | 69604 | 69623 | GTGATGAACATACATAATAA | 59 | 2126 |
| 875177 | N/A | N/A | 71587 | 71606 | CCTGCGGCACTTTCAACAAC | 94 | 2127 |
| 875201 | N/A | N/A | 72955 | 72974 | CACCAAAAGTAGCTCTTTCT | 71 | 2128 |
| 875225 | N/A | N/A | 74767 | 74786 | TCCCAGAACCCACTTCTTCA | 132 | 2129 |
| 875249 | N/A | N/A | 77066 | 77085 | CAGCATACCCAGCTAAGCAC | 124 | 2130 |
| 875273 | N/A | N/A | 79530 | 79549 | ACTATAATGTAAGTCTACCA | 136 | 2131 |
| 875297 | N/A | N/A | 81557 | 81576 | AAAGAAAAGCAAATGAGTC | 77 | 2132 |
| 875321 | N/A | N/A | 82937 | 82956 | CTATCTTCACAACATTTTTT | 93 | 2133 |
| 875345 | N/A | N/A | 84688 | 84707 | CTGTGAGTATCAAATGATAA | 56 | 2134 |
| 875369 | N/A | N/A | 85954 | 85973 | TCAGCTACATGGGCTGTCGC | 121 | 2135 |
| 875393 | N/A | N/A | 88766 | 88785 | CAGATGCTATAGAAACACAC | 40 | 2136 |
| 875417 | N/A | N/A | 91311 | 91330 | TCAATTTCACAGCTGAGATT | 72 | 2137 |
| 875441 | N/A | N/A | 92866 | 92885 | ATTAAAGCTGAATAGATACA | 120 | 2138 |
| 875465 | N/A | N/A | 96065 | 96084 | ACAAAGATGTTCAACATCA | 125 | 2139 |
| 875489 | N/A | N/A | 98062 | 98081 | ATATTTTTTTTTCCACTCT | 32 | 2140 |
| 875513 | N/A | N/A | 99836 | 99855 | AGTGAAGGCAAAAATCAGAC | 83 | 2141 |
| 875537 | N/A | N/A | 102822 | 102841 | TGGCATGGTACTGGCATAAA | 55 | 2142 |
| 875561 | N/A | N/A | 106019 | 106038 | CTCAGTAACAGTCGGAAACT | 103 | 2143 |
| 875585 | N/A | N/A | 109417 | 109436 | GGAATTCTCCCAGATCTTCC | 83 | 2144 |
| 875609 | N/A | N/A | 111754 | 111773 | ATAAGGAACTTAAAAGCTA | 90 | 2145 |
| 875633 | N/A | N/A | 113815 | 113834 | TAAAAAAAAATTGCCTCAAA | 109 | 2146 |

TABLE 29-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 875657 | N/A | N/A | 115792 | 115811 | AAGGCTTTGGCTACAAAAAC | 94 | 2147 |
| 875681 | N/A | N/A | 119037 | 119056 | GACAACAAAAAGTTCCCATT | 38 | 2148 |
| 875705 | N/A | N/A | 121526 | 121545 | ACAGTTGGACAGAGAAGAGG | 76 | 2149 |
| 875729 | N/A | N/A | 125288 | 125307 | CTAACTGTATGCTTAATAGT | 133 | 2150 |
| 875753 | N/A | N/A | 128252 | 128271 | GACTGCCTTAAAAAGGGAAA | 151 | 2151 |
| 875777 | N/A | N/A | 130493 | 130512 | CCAACACTAACTTTCTATCT | 144 | 2152 |
| 875801 | N/A | N/A | 132282 | 132301 | ATGGACATTTTATTTTAAAT | 83 | 2153 |
| 875825 | N/A | N/A | 134120 | 134139 | ACAGCCTTGCTCCTAGCCTG | 75 | 2154 |
| 875849 | N/A | N/A | 136822 | 136841 | TTTTCATAAGAGATGACAAG | 84 | 2155 |
| 875873 | N/A | N/A | 138868 | 138887 | ACATTTGAGACCTCAAATTG | 101 | 2156 |
| 875897 | N/A | N/A | 141190 | 141209 | CCCAGCCTCTTAAAAATGTC | 86 | 2157 |
| 875921 | N/A | N/A | 143195 | 143214 | GTTGAGAATCAGAAGCAGAG | 58 | 2158 |
| 875945 | N/A | N/A | 145674 | 145693 | ATAACCTTCACATTCTACTT | 85 | 2159 |
| 875969 | N/A | N/A | 147105 | 147124 | TCAACCTGGTCTCACTCACT | 69 | 2160 |
| 875993 | N/A | N/A | 148785 | 148804 | TGAAACAGAAAACTGGCAAC | 87 | 2161 |

TABLE 30

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 27 | 32 |
| 874176 | 223 | 242 | 2213 | 2232 | CCGGGCCACCTGGCTGCGGC | 76 | 2162 |
| 874200 | 438 | 457 | 2428 | 2447 | CGCCGAGACCAAGGAGCCGC | 100 | 2163 |
| 874222 | 1127 | 1146 | 49301 | 49320 | AATACTCTCCATTATTTCTT | 42 | 2164 |
| 874245 | 1558 | 1577 | 81718 | 81737 | GTGTATTTTTCTTCCTCACT | 41 | 2165 |
| 874269 | 2097 | 2116 | 88207 | 88226 | GGGATACAAATTCTAGGCCA | 59 | 2166 |
| 874293 | 2670 | 2689 | 112979 | 112998 | AATCCTTAGCACTTGGTTCA | 53 | 2167 |
| 874317 | 3125 | 3144 | 116361 | 116380 | GGCTTGATTCACTGGCATGG | 74 | 2168 |
| 874339 | 4098 | 4117 | 148849 | 148868 | CTCCAGGGCAGCCTTACAAC | 166 | 2169 |
| 874363 | 4262 | 4281 | 149013 | 149032 | CGGTCCAAGTATCTTCCACT | 39 | 2170 |
| 874387 | 4412 | 4431 | 149163 | 149182 | TCTTTTGCTAGCTGATGTGT | 61 | 2171 |
| 874410 | 4586 | 4605 | 149337 | 149356 | ACCACTGTAGACAGTGATCA | 85 | 2172 |
| 874434 | N/A | N/A | 146553 | 146572 | ACCTTGCCAGAGCCTCACTG | 73 | 2173 |
| 874482 | N/A | N/A | 3688 | 3707 | TGCGGATCGGCCACCACCCG | 88 | 2174 |

TABLE 30-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 874506 | N/A | N/A | 4749 | 4768 | TGCAACTTAATAACCTTAGT | 15 | 2175 |
| 874530 | N/A | N/A | 7734 | 7753 | GACTAATTAACCTAGATAAA | 94 | 2176 |
| 874554 | N/A | N/A | 9932 | 9951 | GCTTAGAGTTTTTGCCTTCC | 10 | 2177 |
| 874578 | N/A | N/A | 13355 | 13374 | CTTTAAATGTTAATGAGAAT | 92 | 2178 |
| 874602 | N/A | N/A | 16423 | 16442 | CTCCCAGGCCGGGAGTGGTG | 77 | 2179 |
| 874626 | N/A | N/A | 18328 | 18347 | TAAATAAACTAAGCCTGAGA | 85 | 2180 |
| 874650 | N/A | N/A | 20475 | 20494 | AAGTACATCAGATTCTAATG | 49 | 2181 |
| 874674 | N/A | N/A | 24497 | 24516 | AAACACTTGTTCCTACTGTC | 36 | 2182 |
| 874698 | N/A | N/A | 27969 | 27988 | CAGATATGGCACTACCAGCC | 81 | 2183 |
| 874722 | N/A | N/A | 30818 | 30837 | GTCTGACAGCATCAAATGTG | 79 | 2184 |
| 874746 | N/A | N/A | 32340 | 32359 | GGAAATTAAGTAATATTCCA | 92 | 2185 |
| 874770 | N/A | N/A | 33607 | 33626 | ATCTGAGGTCAGGAACTCAA | 76 | 2186 |
| 874794 | N/A | N/A | 36935 | 36954 | CAGGAATTAAAGGCCAGTCT | 64 | 2187 |
| 874818 | N/A | N/A | 38320 | 38339 | TGTAGAATATACATATTTAC | 100 | 2188 |
| 874842 | N/A | N/A | 41277 | 41296 | TATGAGGGACTAGAGCATCC | 37 | 2189 |
| 874866 | N/A | N/A | 43499 | 43518 | CTAATTTCCACTGATCTATG | 60 | 2190 |
| 874890 | N/A | N/A | 44538 | 44557 | ACATCATTAAAGTGAAATGT | 75 | 2191 |
| 874914 | N/A | N/A | 46468 | 46487 | AAAAGCATAAAGAACTCTGC | 62 | 2192 |
| 874938 | N/A | N/A | 48098 | 48117 | CGCAACCATGCCTCTTTTTT | 90 | 2193 |
| 874962 | N/A | N/A | 50020 | 50039 | CACATGCCCACTTATAAACT | 105 | 2194 |
| 874986 | N/A | N/A | 52556 | 52575 | ACACCCTGACTGTCCAGAGC | 96 | 2195 |
| 875010 | N/A | N/A | 55256 | 55275 | CTCTATGGCTACAGCCATCA | 149 | 2196 |
| 875034 | N/A | N/A | 57481 | 57500 | TCACTAGGTACACAGTTTCA | 64 | 2197 |
| 875058 | N/A | N/A | 59957 | 59976 | TGTGGAAAAAAATTTCCAAA | 90 | 2198 |
| 875082 | N/A | N/A | 62377 | 62396 | GCTCAGGAGTTCAAGACAGC | 99 | 2199 |
| 875106 | N/A | N/A | 64118 | 64137 | CTGCAATCATGCCACTGCGC | 84 | 2200 |
| 875130 | N/A | N/A | 66996 | 67015 | ACTGGTTCTCCAACTGTACT | 101 | 2201 |
| 875154 | N/A | N/A | 69659 | 69678 | GCATTAAATATTAAGATCCA | 92 | 2202 |
| 875178 | N/A | N/A | 71639 | 71658 | TCAAAGTTCCATATAAACCT | 69 | 2203 |
| 875202 | N/A | N/A | 72957 | 72976 | TTCACCAAAAGTAGCTCTTT | 68 | 2204 |
| 875226 | N/A | N/A | 74790 | 74809 | GCCATTCTAAGTGGTTTAAC | 76 | 2205 |
| 875250 | N/A | N/A | 77268 | 77287 | TAACACTCATTTTTGGCAAG | 58 | 2206 |
| 875274 | N/A | N/A | 79564 | 79583 | TAACCTTGGGTCCTCCTGTG | 103 | 2207 |
| 875298 | N/A | N/A | 81589 | 81608 | TCTCTTTCTAAGGGCACTCT | 80 | 2208 |
| 875322 | N/A | N/A | 82976 | 82995 | CCACTTGACCTCTCTATGGC | 132 | 2209 |
| 875346 | N/A | N/A | 84758 | 84777 | GTTTGGAATCTTATTAAGCA | 19 | 2210 |

TABLE 30-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 875370 | N/A | N/A | 86008 | 86027 | TTCTTCTGGCATTCTAAAAA | 74 | 2211 |
| 875394 | N/A | N/A | 88861 | 88880 | ATATTCCTTATGCTAATCAC | 47 | 2212 |
| 875418 | N/A | N/A | 91332 | 91351 | TATAATATCACCCTCTAACA | 95 | 2213 |
| 875442 | N/A | N/A | 92879 | 92898 | AACTGTTAATAGCATTAAAG | 93 | 2214 |
| 875466 | N/A | N/A | 96102 | 96121 | CATCAATCCAAAGAAGATAT | 90 | 2215 |
| 875490 | N/A | N/A | 98063 | 98082 | CATATTTTTTTTTCCACTC | 31 | 2216 |
| 875514 | N/A | N/A | 99918 | 99937 | CTTTAGTAGAGGCGATCCAC | 67 | 2217 |
| 875538 | N/A | N/A | 102856 | 102875 | ATCATTATCTGACTTCAAAT | 82 | 2218 |
| 875562 | N/A | N/A | 106022 | 106041 | GACCTCAGTAACAGTCGGAA | 93 | 2219 |
| 875586 | N/A | N/A | 109466 | 109485 | CATTTGTTTGGAGAAATGTA | 116 | 2220 |
| 875610 | N/A | N/A | 111768 | 111787 | AAAGGAATATGACAATAAAG | 94 | 2221 |
| 875634 | N/A | N/A | 113841 | 113860 | GACATACCTGGAAAAAGTCA | 94 | 2222 |
| 875658 | N/A | N/A | 115994 | 116013 | CTTGGTGTCAGATACAAACA | 62 | 2223 |
| 875682 | N/A | N/A | 119087 | 119106 | AGCCAAACTGTCATGCTTGC | 57 | 2224 |
| 875706 | N/A | N/A | 121576 | 121595 | TAGTAAAAGAAGGCAGATTA | 89 | 2225 |
| 875730 | N/A | N/A | 125327 | 125346 | AACAAACCCACCTCTGCAAA | 66 | 2226 |
| 875754 | N/A | N/A | 128289 | 128308 | TTTGGAGGATAACAGAAAAC | 84 | 2227 |
| 875778 | N/A | N/A | 130500 | 130519 | AACAGATCCAACACTAACTT | 80 | 2228 |
| 875802 | N/A | N/A | 132362 | 132381 | AATGAAATCAGTACTATTTA | 85 | 2229 |
| 875826 | N/A | N/A | 134239 | 134258 | CCTCCCCAAGTTCTTGGATT | 97 | 2230 |
| 875850 | N/A | N/A | 136826 | 136845 | TTCATTTTCATAAGAGATGA | 89 | 2231 |
| 875874 | N/A | N/A | 138983 | 139002 | GGGAAGTTGTGCTAAGGCAA | 45 | 2232 |
| 875898 | N/A | N/A | 141431 | 141450 | GACTACAGGCGCGCCTGGCT | 86 | 2233 |
| 875922 | N/A | N/A | 143582 | 143601 | GAACTGAAAGCCAGTTCTTT | 83 | 2234 |
| 875946 | N/A | N/A | 145831 | 145850 | AAAGGACTGACCAATCAGCA | 51 | 2235 |
| 875970 | N/A | N/A | 147296 | 147315 | TTGCCTCTCTCCCTCTGCTT | 77 | 2236 |
| 875994 | N/A | N/A | 148798 | 148817 | GAAAAGCGAACATTGAAACA | 119 | 2237 |

TABLE 31

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 25 | 32 |
| 874177 | 228 | 247 | 2218 | 2237 | GCCACCCGGGCCACCTGGCT | 104 | 2238 |
| 874201 | 443 | 462 | 2433 | 2452 | AGGCCCGCCGAGACCAAGGA | 111 | 2239 |

TABLE 31-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 874223 | 1131 | 1150 | 49305 | 49324 | ACAAAATACTCTCCATTATT | 69 | 2240 |
| 874246 | 1559 | 1578 | 81719 | 81738 | TGTGTATTTTTCTTCCTCAC | 29 | 2241 |
| 874270 | 2103 | 2122 | 88213 | 88232 | GGTTGTGGGATACAAATTCT | 53 | 2242 |
| 874294 | 2671 | 2690 | 112980 | 112999 | GAATCCTTAGCACTTGGTTC | 59 | 2243 |
| 874318 | 3126 | 3145 | 116362 | 116381 | TGGCTTGATTCACTGGCATG | 82 | 2244 |
| 874340 | 4111 | 4130 | 148862 | 148881 | GGCCTTTCGGTTCCTCCAGG | 68 | 2245 |
| 874364 | 4267 | 4286 | 149018 | 149037 | CTACTCGGTCCAAGTATCTT | 44 | 2246 |
| 874388 | 4417 | 4436 | 149168 | 149187 | TTACTTCTTTTGCTAGCTGA | 31 | 2247 |
| 874411 | 4598 | 4617 | 149349 | 149368 | CTTAAAAGTTGAACCACTGT | 96 | 2248 |
| 874435 | N/A | N/A | 146558 | 146577 | CCCACACCTTGCCAGAGCCT | 74 | 2249 |
| 874483 | N/A | N/A | 3693 | 3712 | AGCAATGCGGATCGGCCACC | 83 | 2250 |
| 874507 | N/A | N/A | 4848 | 4867 | AAAGACCTTGTGGTACTAAA | 53 | 2251 |
| 874531 | N/A | N/A | 7757 | 7776 | ATAAATTACTAATGAAGCCA | 43 | 2252 |
| 874555 | N/A | N/A | 9936 | 9955 | CAAAGCTTAGAGTTTTTGCC | 63 | 2253 |
| 874579 | N/A | N/A | 13511 | 13530 | TATTTGCAACACTGCACTCC | 117 | 2254 |
| 874603 | N/A | N/A | 16532 | 16551 | ACCTGGTGTTATGAGTCACC | 74 | 2255 |
| 874627 | N/A | N/A | 18680 | 18699 | AGTATCTCAGTTTTTTTTTT | 17 | 2256 |
| 874651 | N/A | N/A | 20482 | 20501 | GAAATAAAAGTACATCAGAT | 63 | 2257 |
| 874675 | N/A | N/A | 24888 | 24907 | CCATCCCAGATAACACGGCG | 133 | 2258 |
| 874699 | N/A | N/A | 28082 | 28101 | AAAGACTTTGAAATCTCACA | 21 | 2259 |
| 874723 | N/A | N/A | 30895 | 30914 | TGCATGCCTGCCTTCTCTAC | 74 | 2260 |
| 874747 | N/A | N/A | 32353 | 32372 | TTCATAAGGTTGTGGAAATT | 93 | 2261 |
| 874771 | N/A | N/A | 33816 | 33835 | CGTATGTTTGTCTGTCTTAT | 8 | 2262 |
| 874795 | N/A | N/A | 36992 | 37011 | GGTGCAGCCTGTAGTCTCAG | 69 | 2263 |
| 874819 | N/A | N/A | 38371 | 38390 | TCCACATATATATGTAGAAT | 85 | 2264 |
| 874843 | N/A | N/A | 41450 | 41469 | AATCACTCGAGATTAAAAAC | 67 | 2265 |
| 874867 | N/A | N/A | 43533 | 43552 | TATAAAAAAACAGTACAGTA | 70 | 2266 |
| 874891 | N/A | N/A | 44605 | 44624 | ATAGAATATAATACAACCTA | 70 | 2267 |
| 874915 | N/A | N/A | 46475 | 46494 | CAAAATAAAAGCATAAAGA | 124 | 2268 |
| 874939 | N/A | N/A | 48160 | 48179 | TGTCATACTGTATTGTTTTA | 16 | 2269 |
| 874963 | N/A | N/A | 50170 | 50189 | CTCAAAACCTTGTCTCATAC | 54 | 2270 |
| 874987 | N/A | N/A | 52570 | 52589 | GAAACCCATAGCTCACACCC | 120 | 2271 |
| 875011 | N/A | N/A | 55273 | 55292 | CAGCTACAACTACTCAACTC | 78 | 2272 |
| 875035 | N/A | N/A | 57555 | 57574 | AAAATTAATTTTTAAAGAA | 95 | 2273 |
| 875059 | N/A | N/A | 60014 | 60033 | ACAAGTTATGTTTTAATTCT | 99 | 2274 |
| 875083 | N/A | N/A | 62546 | 62565 | ATTAGGCTTCTGGATCAGGA | 30 | 2275 |

TABLE 31-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 875107 | N/A | N/A | 64341 | 64360 | AGATGCGGTGGCTCATGGCT | 71 | 2276 |
| 875131 | N/A | N/A | 67056 | 67075 | GGTAAAAAAGACACTACATA | 79 | 2277 |
| 875155 | N/A | N/A | 69693 | 69712 | TGTTGGCATAGTAACATACA | 55 | 2278 |
| 875179 | N/A | N/A | 71660 | 71679 | AAATCAGCCTTTTCTCAAAC | 78 | 2279 |
| 875203 | N/A | N/A | 72969 | 72988 | TGGTTTTAAAATTTCACCAA | 115 | 2280 |
| 875227 | N/A | N/A | 74793 | 74812 | GAAGCCATTCTAAGTGGTTT | 84 | 2281 |
| 875251 | N/A | N/A | 77332 | 77351 | ATATGTTACAAATTCTCTTT | 73 | 2282 |
| 875275 | N/A | N/A | 79658 | 79677 | TAAAGGTTGTAATCCATCCC | 46 | 2283 |
| 875299 | N/A | N/A | 81847 | 81866 | ATATAATAACAATACACCGT | 66 | 2284 |
| 875323 | N/A | N/A | 83010 | 83029 | CACAAAGTTTAACAGATGCG | 47 | 2285 |
| 875347 | N/A | N/A | 84815 | 84834 | TGGTTCCTTACAATTATCTA | 26 | 2286 |
| 875371 | N/A | N/A | 86056 | 86075 | TAAGATTGCAAAGCTAACTT | 65 | 2287 |
| 875395 | N/A | N/A | 88869 | 88888 | CTGTCAGCATATTCCTTATG | 62 | 2288 |
| 875419 | N/A | N/A | 91453 | 91472 | CCTTTGTAACACAGACACTA | 43 | 2289 |
| 875443 | N/A | N/A | 93030 | 93049 | TCTATTTTTGGTCAAGACAG | 74 | 2290 |
| 875467 | N/A | N/A | 96143 | 96162 | AAGACAACTCAATTTTTAAA | 167 | 2291 |
| 875491 | N/A | N/A | 98116 | 98135 | TTAGAAAGTTCACTCTTTTA | 87 | 2292 |
| 875515 | N/A | N/A | 99926 | 99945 | ACAAAAATCTTTAGTAGAGG | 88 | 2293 |
| 875539 | N/A | N/A | 102868 | 102887 | AAAACGGGAGGAATCATTAT | 113 | 2294 |
| 875563 | N/A | N/A | 106187 | 106206 | ATAGATTTTGAGACAAAGTC | 103 | 2295 |
| 875587 | N/A | N/A | 109530 | 109549 | GGCCATGGCAGTGCTTGTGT | 103 | 2296 |
| 875611 | N/A | N/A | 111837 | 111856 | AAGCACCAATGGCTGGACCA | 89 | 2297 |
| 875635 | N/A | N/A | 113885 | 113904 | TATTCTAGCATGCAGTAATT | 62 | 2298 |
| 875659 | N/A | N/A | 116005 | 116024 | CCTAAAGAGTGCTTGGTGTC | 68 | 2299 |
| 875683 | N/A | N/A | 119112 | 119131 | TTAGAATGTGACTCTCCCAT | 55 | 2300 |
| 875707 | N/A | N/A | 121601 | 121620 | ATCTAAAGAGGATAAATCTA | 114 | 2301 |
| 875731 | N/A | N/A | 125371 | 125390 | AAGTATTTGAACATAATCCA | 51 | 2302 |
| 875755 | N/A | N/A | 128357 | 128376 | AAAAAAAATTCCAGAAGTTT | 81 | 2303 |
| 875779 | N/A | N/A | 130588 | 130607 | GCATTATGAAATCGCTTCTC | 45 | 2304 |
| 875803 | N/A | N/A | 132506 | 132525 | CCATAATCTCATTCTCATAG | 31 | 2305 |
| 875827 | N/A | N/A | 134571 | 134590 | AGAACATGCTTAAGCAGATT | 59 | 2306 |
| 875851 | N/A | N/A | 137089 | 137108 | GGCACAAGGAAAATATTGTT | 53 | 2307 |
| 875875 | N/A | N/A | 139090 | 139109 | GACCAAACCATCATAAAATG | 64 | 2308 |
| 875899 | N/A | N/A | 141630 | 141649 | AAAAATTTATTTTTGAATAA | 98 | 2309 |
| 875923 | N/A | N/A | 143668 | 143687 | GAGTGCCCCAGCCCTTTGGA | 106 | 2310 |
| 875947 | N/A | N/A | 145860 | 145879 | GATATTTTTAAGGTCTCAGT | 37 | 2311 |

TABLE 31-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 875971 | N/A | N/A | 147316 | 147335 | TTACTTGGACCTCTGTTCAT | 84 | 2312 |
| 875995 | N/A | N/A | 148812 | 148831 | TTGTACTGTAAAAGAAAAG | 104 | 2313 |

TABLE 32

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 15 | 32 |
| 937361 | 893 | 912 | 45747 | 45766 | TTTGTTACTGTTTCGACCTC | 56 | 2314 |
| 937371 | 2359 | 2378 | 91243 | 91262 | GCTCTGTTCGATGCAGGACT | 43 | 2315 |
| 937383 | 4394 | 4413 | 149145 | 149164 | GTTCATGACTTTCAAGGGTT | 10 | 2316 |
| 937394 | 4414 | 4433 | 149165 | 149184 | CTTCTTTTGCTAGCTGATGT | 32 | 2317 |
| 937418 | N/A | N/A | 4092 | 4111 | TTCCTTCTCCCTTTGAACAC | 59 | 2318 |
| 937430 | N/A | N/A | 4535 | 4554 | TGGCTAAGTAGTGTTTGGGA | 4 | 2319 |
| 937442 | N/A | N/A | 4776 | 4795 | AATCTAATTTTTAAGCCTAG | 65 | 2320 |
| 937454 | N/A | N/A | 6855 | 6874 | CTTTCAGATGAAAAGAAAG | 99 | 2321 |
| 937466 | N/A | N/A | 9235 | 9254 | GGTAACAGTAACATCATAGA | 13 | 2322 |
| 937478 | N/A | N/A | 10346 | 10365 | ATGATCTTGTGTATATATTA | 9 | 2323 |
| 937490 | N/A | N/A | 11385 | 11404 | CGTAAGTACAGAACCACATA | 34 | 2324 |
| 937502 | N/A | N/A | 16613 | 16632 | CTAATGTGTTTCACAATCTA | 58 | 2325 |
| 937514 | N/A | N/A | 17511 | 17530 | TTCTGGACACCAAGGTGGGT | 80 | 2326 |
| 937526 | N/A | N/A | 19926 | 19945 | CATTACGACCATTCTGCTCA | 31 | 2327 |
| 937538 | N/A | N/A | 21223 | 21242 | GAATTCGAGGTTACACAGTT | 45 | 2328 |
| 937550 | N/A | N/A | 23395 | 23414 | TTGTCTACAGTAGCATACAG | 47 | 2329 |
| 937562 | N/A | N/A | 27188 | 27207 | CTCTGTCGCCTGGGATGGTA | 89 | 2330 |
| 937574 | N/A | N/A | 28086 | 28105 | AAGCAAAGACTTTGAAATCT | 38 | 2331 |
| 937586 | N/A | N/A | 28814 | 28833 | AGTGAGTTCCATACTCTAAT | 73 | 2332 |
| 937598 | N/A | N/A | 29042 | 29061 | CAGTAATTAAGAATAAAATG | 134 | 2333 |
| 937610 | N/A | N/A | 32328 | 32347 | ATATTCCATACAGATCGCAT | 19 | 2334 |
| 937622 | N/A | N/A | 32798 | 32817 | CTTCTTGTTGTTGTTTACAT | 22 | 2335 |
| 937634 | N/A | N/A | 32811 | 32830 | TTCCAATTTCAGACTTCTTG | 15 | 2336 |
| 937646 | N/A | N/A | 33812 | 33831 | TGTTTGTCTGTCTTATTCAC | 31 | 2337 |
| 937658 | N/A | N/A | 36314 | 36333 | GTGCTCTCTTTGCGCCTGTG | 22 | 2338 |
| 937670 | N/A | N/A | 36853 | 36872 | TGAATCAGTATTTACTACTT | 37 | 2339 |

TABLE 32-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 937682 | N/A | N/A | 38658 | 38677 | AATGGGATAAATATATACAA | 75 | 2340 |
| 937694 | N/A | N/A | 41726 | 41745 | AAGAGTTAATGATGCTTTCA | 29 | 2341 |
| 937706 | N/A | N/A | 45475 | 45494 | AAGTAAAATAGCCTACTGGA | 78 | 2342 |
| 937718 | N/A | N/A | 48284 | 48303 | AATACTTAAGTCACTTACAT | 92 | 2343 |
| 937730 | N/A | N/A | 49049 | 49068 | AAAAATCCTCATATCTAAAT | 98 | 2344 |
| 937742 | N/A | N/A | 49167 | 49186 | TGTTAGGAATTCTTTAGCTC | 24 | 2345 |
| 937754 | N/A | N/A | 50792 | 50811 | TCCAAGTAACAGTGTAGAAG | 4 | 2346 |
| 937766 | N/A | N/A | 52956 | 52975 | CAGTTGCCAATTCTGAGACA | 73 | 2347 |
| 937778 | N/A | N/A | 55537 | 55556 | AGTAATTCTTCAGACTAAAT | 103 | 2348 |
| 937790 | N/A | N/A | 57468 | 57487 | AGTTTCACTAGGTTCTCAAA | 41 | 2349 |
| 937802 | N/A | N/A | 58557 | 58576 | TCTTTCTTTTAATCTCAATA | 50 | 2350 |
| 937814 | N/A | N/A | 60511 | 60530 | TTTTGTTTAATCACAGTTTT | 65 | 2351 |
| 937826 | N/A | N/A | 63945 | 63964 | AACAAACAGAGAGGAACTGC | 68 | 2352 |
| 937838 | N/A | N/A | 68930 | 68949 | AGAATCCACAGATCCAGGTG | 46 | 2353 |
| 937850 | N/A | N/A | 69823 | 69842 | ATGGGCCCCTTCAATATTTT | 75 | 2354 |
| 937862 | N/A | N/A | 73009 | 73028 | GAAAACACAGAAGTGTGATT | 100 | 2355 |
| 937874 | N/A | N/A | 74344 | 74363 | CAGTACTGTAAGTTGCCACT | 78 | 2356 |
| 937886 | N/A | N/A | 81784 | 81803 | ATTTCCTTTAAATACCTAGT | 55 | 2357 |
| 937898 | N/A | N/A | 82355 | 82374 | ACTATCAACTGCCACTGCTG | 77 | 2358 |
| 937910 | N/A | N/A | 82849 | 82868 | TGGCTCCAATATCGGCAATG | 43 | 2359 |
| 937922 | N/A | N/A | 82961 | 82980 | ATGGCTGATTCCATCAATCT | 76 | 2360 |
| 937934 | N/A | N/A | 83785 | 83804 | ACATAGGTTAGAATTTTCCA | 10 | 2361 |
| 937946 | N/A | N/A | 83992 | 84011 | GTTTCTTTTACTTAAGTTGC | 21 | 2362 |
| 937958 | N/A | N/A | 84403 | 84422 | CATATATTTCTCAGCCCCCT | 54 | 2363 |
| 937970 | N/A | N/A | 84703 | 84722 | TAGAGTTTGTGACTCCTGTG | 83 | 2364 |
| 937982 | N/A | N/A | 84773 | 84792 | TGAACCCAGAACTCAGTTTG | 74 | 2365 |
| 937994 | N/A | N/A | 84921 | 84940 | TAAATCACAATAATTCCTAC | 100 | 2366 |
| 938006 | N/A | N/A | 85155 | 85174 | TTGATTTGTGATAAGTTTTA | 45 | 2367 |
| 938018 | N/A | N/A | 85199 | 85218 | CAAAAATGATTTCTTGTACA | 74 | 2368 |
| 938030 | N/A | N/A | 95476 | 95495 | TTAACGGTTGCTTAGGGTTG | 24 | 2369 |
| 938042 | N/A | N/A | 97620 | 97639 | AGACTTTTTATGTTGCTCCT | 15 | 2370 |
| 938054 | N/A | N/A | 98577 | 98596 | AGCAATTCTTACACAAATAA | 67 | 2371 |
| 938066 | N/A | N/A | 100145 | 100164 | TCAGTATAGGCAAACCAATT | 82 | 2372 |
| 938078 | N/A | N/A | 107363 | 107382 | AAGTTAAAAAGCGGGCAGAT | 64 | 2373 |
| 938090 | N/A | N/A | 111222 | 111241 | CTGGGCCTAGTCAGCTTGGA | 92 | 2374 |
| 938102 | N/A | N/A | 118404 | 118423 | ACCCAAAAAAACACATTGAG | 83 | 2375 |

TABLE 32-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 938114 | N/A | N/A | 119032 | 119051 | CAAAAAGTTCCCATTGCATT | 50 | 2376 |
| 938126 | N/A | N/A | 123992 | 124011 | CAATATTCTGAGAAAGGACT | 53 | 2377 |
| 938138 | N/A | N/A | 125932 | 125951 | TAATTATAGAGTTCATATGG | 54 | 2378 |
| 938150 | N/A | N/A | 129788 | 129807 | TTACTTATTACCTTCCTGTA | 61 | 2379 |
| 938162 | N/A | N/A | 130897 | 130916 | AAAAAAGCAGACTGCCTATT | 107 | 2380 |
| 938174 | N/A | N/A | 132166 | 132185 | TTTTTGCTTATTATTCTCAC | 11 | 2381 |
| 938186 | N/A | N/A | 132523 | 132542 | CATGTAGTTACATGTAACCA | 40 | 2382 |
| 938198 | N/A | N/A | 133814 | 133833 | GGCTGTTTCAAAACCAATGA | 42 | 2383 |
| 938210 | N/A | N/A | 135083 | 135102 | GGTCAAGGTCAATACTTTTT | 7 | 2384 |
| 938222 | N/A | N/A | 137933 | 137952 | GCTGTCCAAGATAATGACCT | 82 | 2385 |
| 938234 | N/A | N/A | 139269 | 139288 | TTAATTTGTAACTAGGTTTT | 73 | 2386 |
| 938246 | N/A | N/A | 141230 | 141249 | CCCCTACTGTTAAACCATTA | 112 | 2387 |
| 938258 | N/A | N/A | 144253 | 144272 | ATGTCTGACAACCTCCATCG | 92 | 2388 |
| 938270 | N/A | N/A | 146666 | 146685 | CAGAACCTAAACTTTGCAGG | 57 | 2389 |

TABLE 33

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 18 | 32 |
| 937362 | 894 | 913 | 45748 | 45767 | CTTTGTTACTGTTTCGACCT | 36 | 2390 |
| 937372 | 2455 | 2474 | 91725 | 91744 | GTTTCATTGGGTTTAATATT | 21 | 2391 |
| 937384 | 4395 | 4414 | 149146 | 149165 | TGTTCATGACTTTCAAGGGT | 18 | 2392 |
| 937395 | 4415 | 4434 | 149166 | 149185 | ACTTCTTTTGCTAGCTGATG | 21 | 2393 |
| 937407 | N/A | N/A | 3132 | 3151 | GGGAGGCCGCCCGCTCCCTC | 108 | 2394 |
| 937419 | N/A | N/A | 4093 | 4112 | TTTCCTTCTCCCTTTGAACA | 50 | 2395 |
| 937431 | N/A | N/A | 4652 | 4671 | ACATCCTTTTCTATAAAAGT | 53 | 2396 |
| 937443 | N/A | N/A | 4898 | 4917 | GAAAAATCTAAATTAACCTT | 97 | 2397 |
| 937455 | N/A | N/A | 6965 | 6984 | GGAATGTAGAAGAAGAAGAG | 72 | 2398 |
| 937467 | N/A | N/A | 9927 | 9946 | GAGTTTTGCCTTCCATTTT | 12 | 2399 |
| 937479 | N/A | N/A | 10347 | 10366 | CATGATCTTGTGTATATATT | 13 | 2400 |
| 937491 | N/A | N/A | 12994 | 13013 | ACAGCTGTGACAAGTTTTCA | 63 | 2401 |
| 937503 | N/A | N/A | 16634 | 16653 | AAAAATGCTTGTCATAATCC | 44 | 2402 |
| 937515 | N/A | N/A | 18265 | 18284 | AAGTGCCAACCATTCAAGAA | 31 | 2403 |
| 937527 | N/A | N/A | 19927 | 19946 | TCATTACGACCATTCTGCTC | 70 | 2404 |

TABLE 33-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 937539 | N/A | N/A | 21520 | 21539 | TGACCAATGCTCCTCTCTGC | 53 | 2405 |
| 937551 | N/A | N/A | 24044 | 24063 | AACCAGTAAGTTAAGGTAAA | 65 | 2406 |
| 937563 | N/A | N/A | 27762 | 27781 | CCAGAAAAAATGGCCACTAC | 58 | 2407 |
| 937575 | N/A | N/A | 28087 | 28106 | AAAGCAAAGACTTTGAAATC | 90 | 2408 |
| 937587 | N/A | N/A | 28884 | 28903 | TGTTCAGTGTCCTTCTAGCC | 41 | 2409 |
| 937599 | N/A | N/A | 30084 | 30103 | CAGTGAGGAAGGAGACCATC | 51 | 2410 |
| 937611 | N/A | N/A | 32330 | 32349 | TAATATTCCATACAGATCGC | 12 | 2411 |
| 937623 | N/A | N/A | 32799 | 32818 | ACTTCTTGTTGTTGTTTACA | 24 | 2412 |
| 937635 | N/A | N/A | 32812 | 32831 | CTTCCAATTTCAGACTTCTT | 20 | 2413 |
| 937647 | N/A | N/A | 33813 | 33832 | ATGTTTGTCTGTCTTATTCA | 22 | 2414 |
| 937659 | N/A | N/A | 36315 | 36334 | TGTGCTCTCTTTGCGCCTGT | 27 | 2415 |
| 937671 | N/A | N/A | 36854 | 36873 | ATGAATCAGTATTTACTACT | 42 | 2416 |
| 937683 | N/A | N/A | 38876 | 38895 | GCATCACTACTTGGTAACAC | 15 | 2417 |
| 937695 | N/A | N/A | 42730 | 42749 | TTTACCATTCTGTCTACTTT | 70 | 2418 |
| 937707 | N/A | N/A | 45616 | 45635 | AGAGCTCACCTAATATTAAG | 105 | 2419 |
| 937719 | N/A | N/A | 48304 | 48323 | CTTCAGATACCGAATTACAT | 61 | 2420 |
| 937731 | N/A | N/A | 49069 | 49088 | TATTATCCATTCCATCATTT | 55 | 2421 |
| 937743 | N/A | N/A | 49174 | 49193 | TAAAATTGTTAGGAATTCT | 87 | 2422 |
| 937755 | N/A | N/A | 50918 | 50937 | AGAACACTGTGCTTTCATCA | 38 | 2423 |
| 937767 | N/A | N/A | 52985 | 53004 | CAAATGATAACAGCAGAGAC | 100 | 2424 |
| 937779 | N/A | N/A | 55654 | 55673 | AGAAGATAAATTTGTAGATA | 82 | 2425 |
| 937791 | N/A | N/A | 57469 | 57488 | CAGTTTCACTAGGTTCTCAA | 14 | 2426 |
| 937803 | N/A | N/A | 58599 | 58618 | ATTCTGTTTAGCTTTCCATT | 37 | 2427 |
| 937815 | N/A | N/A | 61017 | 61036 | TTTCTACTTTTCCCAGTTTG | 63 | 2428 |
| 937827 | N/A | N/A | 64531 | 64550 | CAGGATTATGTATAAATCAA | 41 | 2429 |
| 937839 | N/A | N/A | 68933 | 68952 | TTGAGAATCCACAGATCCAG | 78 | 2430 |
| 937851 | N/A | N/A | 69849 | 69868 | GGGATTCTTAGCCTTTTTCT | 73 | 2431 |
| 937863 | N/A | N/A | 73122 | 73141 | AATGCTACATTTTAATCTTA | 71 | 2432 |
| 937875 | N/A | N/A | 74437 | 74456 | CCCATAGGGTACCACCTACT | 95 | 2433 |
| 937887 | N/A | N/A | 81832 | 81851 | ACCGTCTCACACAGACCTTG | 66 | 2434 |
| 937899 | N/A | N/A | 82395 | 82414 | TTAGCATGACATGCCAAGTC | 58 | 2435 |
| 937911 | N/A | N/A | 82850 | 82869 | ATGGCTCCAATATCGGCAAT | 39 | 2436 |
| 937923 | N/A | N/A | 82991 | 83010 | GTGCTCATTCTCATCCCACT | 29 | 2437 |
| 937935 | N/A | N/A | 83786 | 83805 | CACATAGGTTAGAATTTTCC | 24 | 2438 |
| 937947 | N/A | N/A | 84055 | 84074 | ACAAGATATATTCAACCTAG | 35 | 2439 |
| 937959 | N/A | N/A | 84404 | 84423 | TCATATATTTCTCAGCCCCC | 51 | 2440 |

TABLE 33-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 937971 | N/A | N/A | 84743 | 84762 | AAGCAAGTCCCATTTAAGTA | 26 | 2441 |
| 937983 | N/A | N/A | 84800 | 84819 | ATCTATGATTTTCATCAGGT | 6 | 2442 |
| 937995 | N/A | N/A | 84951 | 84970 | ATATAACATACACTAGATAA | 99 | 2443 |
| 938007 | N/A | N/A | 85169 | 85188 | TTGAGGACAGTCATTTGATT | 57 | 2444 |
| 938019 | N/A | N/A | 85287 | 85306 | CACCTGACAGAACAAATGAT | 103 | 2445 |
| 938031 | N/A | N/A | 95719 | 95738 | AGAACACCACAAATAGCTAC | 67 | 2446 |
| 938043 | N/A | N/A | 97622 | 97641 | TAAGACTTTTTATGTTGCTC | 6 | 2447 |
| 938055 | N/A | N/A | 98657 | 98676 | ATGTATAGAGGCCAACATTC | 85 | 2448 |
| 938067 | N/A | N/A | 100218 | 100237 | AACAAGCTAAAGAGAAACCT | 114 | 2449 |
| 938079 | N/A | N/A | 108591 | 108610 | GTCTCTCAATAGCAGAAATG | 89 | 2450 |
| 938091 | N/A | N/A | 111368 | 111387 | TGGGCAGTCTATACGGAATT | 52 | 2451 |
| 938103 | N/A | N/A | 118784 | 118803 | CGAAAATTAAGAGTTTTAGT | 83 | 2452 |
| 938115 | N/A | N/A | 119033 | 119052 | ACAAAAAGTTCCCATTGCAT | 56 | 2453 |
| 938127 | N/A | N/A | 124091 | 124110 | AAGCATGAACCTTAAGAGAA | 58 | 2454 |
| 938139 | N/A | N/A | 126290 | 126309 | AAAAGTTACCACAATATGAA | 86 | 2455 |
| 938151 | N/A | N/A | 129789 | 129808 | GTTACTTATTACCTTCCTGT | 14 | 2456 |
| 938163 | N/A | N/A | 131674 | 131693 | GTTCATCTTTTCCTTCAGAT | 10 | 2457 |
| 938175 | N/A | N/A | 132167 | 132186 | TTTTTTGCTTATTATTCTCA | 19 | 2458 |
| 938187 | N/A | N/A | 132524 | 132543 | CCATGTAGTTACATGTAACC | 48 | 2459 |
| 938199 | N/A | N/A | 133894 | 133913 | CCCACTGCTCTTCAAATGGA | 68 | 2460 |
| 938211 | N/A | N/A | 136171 | 136190 | AGAGTAGATGTGAGGCTGGG | 105 | 2461 |
| 938223 | N/A | N/A | 137934 | 137953 | TGCTGTCCAAGATAATGACC | 85 | 2462 |
| 938235 | N/A | N/A | 139270 | 139289 | TTTAATTTGTAACTAGGTTT | 42 | 2463 |
| 938247 | N/A | N/A | 141590 | 141609 | AAGTAGCTAATACGGTGGAC | 30 | 2464 |
| 938259 | N/A | N/A | 144271 | 144290 | GGAGCATGTACACAACCGAT | 108 | 2465 |
| 938271 | N/A | N/A | 146726 | 146745 | GACCAAACCGGCTTCCCTCC | 94 | 2466 |

TABLE 34

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 21 | 32 |
| 937363 | 1075 | 1094 | 49249 | 49268 | TTCTCATGTGCGGCATCAAG | 35 | 2467 |
| 937373 | 2456 | 2475 | 91726 | 91745 | TGTTTCATTGGGTTTAATAT | 33 | 2468 |

TABLE 34-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 937385 | 4396 | 4415 | 149147 | 149166 | GTGTTCATGACTTTCAAGGG | 11 | 2469 |
| 937396 | 4416 | 4435 | 149167 | 149186 | TACTTCTTTTGCTAGCTGAT | 23 | 2470 |
| 937408 | N/A | N/A | 3161 | 3180 | CGAGAACCCCTCCCAACACG | 128 | 2471 |
| 937420 | N/A | N/A | 4094 | 4113 | GTTTCCTTCTCCCTTTGAAC | 14 | 2472 |
| 937432 | N/A | N/A | 4744 | 4763 | CTTAATAACCTTAGTTTTAA | 102 | 2473 |
| 937444 | N/A | N/A | 5108 | 5127 | TAAGTGAGGAGATTCTAGAA | 56 | 2474 |
| 937456 | N/A | N/A | 7006 | 7025 | GTAACAATTGTAAATCCATA | 10 | 2475 |
| 937468 | N/A | N/A | 9928 | 9947 | AGAGTTTTGCCTTCCATTT | 9 | 2476 |
| 937480 | N/A | N/A | 10348 | 10367 | GCATGATCTTGTGTATATAT | 8 | 2477 |
| 937492 | N/A | N/A | 13405 | 13424 | TCACTTGACACAACTTCAGG | 58 | 2478 |
| 937504 | N/A | N/A | 17153 | 17172 | ATTACAATGCGGTATATATA | 32 | 2479 |
| 937516 | N/A | N/A | 18278 | 18297 | TGACCAAGCAGTTAAGTGCC | 45 | 2480 |
| 937528 | N/A | N/A | 19929 | 19948 | CATCATTACGACCATTCTGC | 42 | 2481 |
| 937540 | N/A | N/A | 22556 | 22575 | ACAGTTTAGCAATTACTTTT | 23 | 2482 |
| 937552 | N/A | N/A | 24447 | 24466 | GCAAATATTTCCAAACAAGT | 13 | 2483 |
| 937564 | N/A | N/A | 28019 | 28038 | AAAGGCAATTTCCTTAATTT | 47 | 2484 |
| 937576 | N/A | N/A | 28162 | 28181 | GCTCCCAGCCTTCTTCACTG | 76 | 2485 |
| 937588 | N/A | N/A | 28885 | 28904 | TTGTTCAGTGTCCTTCTAGC | 24 | 2486 |
| 937600 | N/A | N/A | 30151 | 30170 | CTCGAATGGCAGAACAATGA | 57 | 2487 |
| 937612 | N/A | N/A | 32331 | 32350 | GTAATATTCCATACAGATCG | 33 | 2488 |
| 937624 | N/A | N/A | 32800 | 32819 | GACTTCTTGTTGTTGTTTAC | 21 | 2489 |
| 937636 | N/A | N/A | 32813 | 32832 | TCTTCCAATTTCAGACTTCT | 24 | 2490 |
| 937648 | N/A | N/A | 33814 | 33833 | TATGTTTGTCTGTCTTATTC | 32 | 2491 |
| 937660 | N/A | N/A | 36316 | 36335 | ATGTGCTCTCTTTGCGCCTG | 41 | 2492 |
| 937672 | N/A | N/A | 36855 | 36874 | CATGAATCAGTATTTACTAC | 35 | 2493 |
| 937684 | N/A | N/A | 41272 | 41291 | GGGACTAGAGCATCCATAAA | 52 | 2494 |
| 937696 | N/A | N/A | 43208 | 43227 | TGCTTTTAATAGTTGCCAAA | 43 | 2495 |
| 937708 | N/A | N/A | 47531 | 47550 | TACCCCCAAGGCAGTTTATC | 109 | 2496 |
| 937720 | N/A | N/A | 48512 | 48531 | GAACTCTTGAAATTCTTCAG | 37 | 2497 |
| 937732 | N/A | N/A | 49142 | 49161 | GGTACCAGTTCTTATATGCC | 67 | 2498 |
| 937744 | N/A | N/A | 49194 | 49213 | TACTCCAAACCTTTACAAAA | 94 | 2499 |
| 937756 | N/A | N/A | 50938 | 50957 | ATTTGAGAAGATTCAAAAAC | 84 | 2500 |
| 937768 | N/A | N/A | 53154 | 53173 | CTTAATAATTTGACAGACTA | 64 | 2501 |
| 937780 | N/A | N/A | 55995 | 56014 | ACTAAAACCAGAGGAAAAAT | 89 | 2502 |
| 937792 | N/A | N/A | 57472 | 57491 | ACACAGTTTCACTAGGTTCT | 11 | 2503 |
| 937804 | N/A | N/A | 58742 | 58761 | AGTTATTGTTCTGACTTTGG | 14 | 2504 |

TABLE 34-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 937816 | N/A | N/A | 61164 | 61183 | GCAAGCTGATAGACAATCAT | 71 | 2505 |
| 937828 | N/A | N/A | 65549 | 65568 | TAAACAACAGTGGCCACTGA | 92 | 2506 |
| 937840 | N/A | N/A | 69102 | 69121 | GTTCTATAGGTGCTTAAGTC | 38 | 2507 |
| 937852 | N/A | N/A | 69978 | 69997 | CACAGTTAAGGGTGCAGGAT | 45 | 2508 |
| 937864 | N/A | N/A | 73447 | 73466 | AAATTAAAGCTCGAAGCAGC | 92 | 2509 |
| 937876 | N/A | N/A | 74496 | 74515 | GGGCAATGATGGCACTAGGA | 51 | 2510 |
| 937888 | N/A | N/A | 81875 | 81894 | TACCTAAGCTATATTAAAGG | 96 | 2511 |
| 937900 | N/A | N/A | 82425 | 82444 | TCACCCCATCTCCTTCCAAC | 86 | 2512 |
| 937912 | N/A | N/A | 82851 | 82870 | CATGGCTCCAATATCGGCAA | 35 | 2513 |
| 937924 | N/A | N/A | 83053 | 83072 | TCTAACCTCTGGACTGTCCC | 68 | 2514 |
| 937936 | N/A | N/A | 83787 | 83806 | GCACATAGGTTAGAATTTTC | 4 | 2515 |
| 937948 | N/A | N/A | 84087 | 84106 | TATCCCTGATTTATGGAAAA | 79 | 2516 |
| 937960 | N/A | N/A | 84405 | 84424 | ATCATATATTTCTCAGCCCC | 39 | 2517 |
| 937972 | N/A | N/A | 84753 | 84772 | GAATCTTATTAAGCAAGTCC | 8 | 2518 |
| 937984 | N/A | N/A | 84810 | 84829 | CCTTACAATTATCTATGATT | 48 | 2519 |
| 937996 | N/A | N/A | 85039 | 85058 | CTATACACACTATTGAAGAA | 58 | 2520 |
| 938008 | N/A | N/A | 85179 | 85198 | TTTTAACCCTTTGAGGACAG | 51 | 2521 |
| 938020 | N/A | N/A | 85288 | 85307 | ACACCTGACAGAACAAATGA | 91 | 2522 |
| 938032 | N/A | N/A | 95819 | 95838 | CAACTCCTAGGTAGGTACAC | 41 | 2523 |
| 938044 | N/A | N/A | 97623 | 97642 | ATAAGACTTTTTATGTTGCT | 18 | 2524 |
| 938056 | N/A | N/A | 98775 | 98794 | AAACACTTTATAGGCAATAT | 56 | 2525 |
| 938068 | N/A | N/A | 101519 | 101538 | AATCAGTTTATTGAAGGAAT | 88 | 2526 |
| 938080 | N/A | N/A | 108675 | 108694 | GAGACTGCAATAATTATTAG | 85 | 2527 |
| 938092 | N/A | N/A | 112470 | 112489 | GTTTCTCAGTAAAGTGTCAG | 86 | 2528 |
| 938104 | N/A | N/A | 118926 | 118945 | ACCCACTTTCTTCTCAGAAT | 87 | 2529 |
| 938116 | N/A | N/A | 119657 | 119676 | CAAAAGCATTACTCATTGCC | 61 | 2530 |
| 938128 | N/A | N/A | 124624 | 124643 | ATACAATACAGTCAACTGAA | 112 | 2531 |
| 938140 | N/A | N/A | 127721 | 127740 | AAAAACTAAGGGAAAAACTG | 85 | 2532 |
| 938152 | N/A | N/A | 129791 | 129810 | TTGTTACTTATTACCTTCCT | 27 | 2533 |
| 938164 | N/A | N/A | 131723 | 131742 | GTAGAAACTATTTGCCAAAA | 44 | 2534 |
| 938176 | N/A | N/A | 132216 | 132235 | AAGTTGATCTACACAAATTT | 69 | 2535 |
| 938188 | N/A | N/A | 132525 | 132544 | CCCATGTAGTTACATGTAAC | 46 | 2536 |
| 938200 | N/A | N/A | 133952 | 133971 | GTTTTGTTTGCAACATTTCC | 50 | 2537 |
| 938212 | N/A | N/A | 136441 | 136460 | TATTTGAGTGTATTTAAATA | 91 | 2538 |
| 938224 | N/A | N/A | 138034 | 138053 | TACCTTAAAAGTTCATTTCC | 64 | 2539 |
| 938236 | N/A | N/A | 139272 | 139291 | TGTTTAATTTGTAACTAGGT | 20 | 2540 |

TABLE 34-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 938248 | N/A | N/A | 142489 | 142508 | TCTGAATGTTTTTAAGAGTA | 37 | 2541 |
| 938260 | N/A | N/A | 145644 | 145663 | GAAAGTTGGCTAAAGCTGGT | 84 | 2542 |
| 938272 | N/A | N/A | 146738 | 146757 | CTGGCCCACACGGACCAAAC | 100 | 2543 |

TABLE 35

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708151 | 1084 | 1103 | 49258 | 49277 | TCTGTACTTTTCTCATGTGC | 50 | 2544 |
| 708199 | 1477 | 1496 | 81637 | 81656 | GCTAACTGGTTTGCCCTTGC | 32 | 32 |
| 937375 | 2467 | 2486 | 91737 | 91756 | AAGCTAGGTGATGTTTCATT | 55 | 2545 |
| 937387 | 4399 | 4418 | 149150 | 149169 | GATGTGTTCATGACTTTCAA | 36 | 2546 |
| 937398 | 4419 | 4438 | 149170 | 149189 | TGTTACTTCTTTTGCTAGCT | 49 | 2547 |
| 937410 | N/A | N/A | 3453 | 3472 | CGATCTTTCCCAGGACTCGG | 87 | 2548 |
| 937422 | N/A | N/A | 4526 | 4545 | AGTGTTTGGGATGCTTCAGA | 6 | 2549 |
| 937434 | N/A | N/A | 4746 | 4765 | AACTTAATAACCTTAGTTTT | 86 | 2550 |
| 937446 | N/A | N/A | 5301 | 5320 | CACTTCTGAAAGTCATGAAA | 53 | 2551 |
| 937458 | N/A | N/A | 7351 | 7370 | AATTTAAATGGAAGCATGAT | 82 | 2552 |
| 937470 | N/A | N/A | 9930 | 9949 | TTAGAGTTTTTGCCTTCCAT | 5 | 2553 |
| 937482 | N/A | N/A | 10351 | 10370 | ACAGCATGATCTTGTGTATA | 30 | 2554 |
| 937494 | N/A | N/A | 13774 | 13793 | GTTAGCTATTAATCATGGCA | 20 | 2555 |
| 937506 | N/A | N/A | 17155 | 17174 | GAATTACAATGCGGTATATA | 22 | 2556 |
| 937518 | N/A | N/A | 18682 | 18701 | CCAGTATCTCAGTTTTTTTT | 35 | 2557 |
| 937530 | N/A | N/A | 19932 | 19951 | GCGCATCATTACGACCATTC | 50 | 2558 |
| 937542 | N/A | N/A | 23248 | 23267 | ATTTTTACTCACCTTTTCTA | 80 | 2559 |
| 937554 | N/A | N/A | 24984 | 25003 | ATAAACACAGGGTAGGCCAG | 96 | 2560 |
| 937566 | N/A | N/A | 28077 | 28096 | CTTTGAAATCTCACAAGGTT | 60 | 2561 |
| 937578 | N/A | N/A | 28492 | 28511 | GGATTGTTTTCTTCATTATT | 16 | 2562 |
| 937590 | N/A | N/A | 28887 | 28906 | TCTTGTTCAGTGTCCTTCTA | 21 | 2563 |
| 937602 | N/A | N/A | 30535 | 30554 | AAATAACTTGCCTTACATCA | 62 | 2564 |
| 937614 | N/A | N/A | 32333 | 32352 | AAGTAATATTCCATACAGAT | 34 | 2565 |
| 937626 | N/A | N/A | 32802 | 32821 | CAGACTTCTTGTTGTTGTTT | 28 | 2566 |
| 937638 | N/A | N/A | 32815 | 32834 | GTTCTTCCAATTTCAGACTT | 34 | 2567 |
| 937650 | N/A | N/A | 35590 | 35609 | AAATGTTTTCATAACTGCTA | 54 | 2568 |
| 937662 | N/A | N/A | 36318 | 36337 | ACATGTGCTCTCTTTGCGCC | 76 | 2569 |

TABLE 35-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 937674 | N/A | N/A | 37450 | 37469 | AACAACCAAGCTTGGCAAAA | 67 | 2570 |
| 937686 | N/A | N/A | 41274 | 41293 | GAGGGACTAGAGCATCCATA | 53 | 2571 |
| 937698 | N/A | N/A | 43423 | 43442 | CCACTGAAGTCTAAATTCTT | 82 | 2572 |
| 937710 | N/A | N/A | 47568 | 47587 | TTTATCCACATTTTAACTTC | 74 | 2573 |
| 937722 | N/A | N/A | 48559 | 48578 | TTCACTAACAAAACAATAAA | 97 | 2574 |
| 937734 | N/A | N/A | 49148 | 49167 | CATCAAGGTACCAGTTCTTA | 22 | 2575 |
| 937746 | N/A | N/A | 49874 | 49893 | ATTTTTCTCTAAAGTTCTAA | 76 | 2576 |
| 937758 | N/A | N/A | 51327 | 51346 | AGGAATGGACTATCACAAAC | 40 | 2577 |
| 937770 | N/A | N/A | 54510 | 54529 | TTCCCCAGCAGCCGAGTGTG | 83 | 2578 |
| 937782 | N/A | N/A | 56810 | 56829 | TAATGGCTAGAAGAATTCAG | 83 | 2579 |
| 937794 | N/A | N/A | 57474 | 57493 | GTACACAGTTTCACTAGGTT | 4 | 2580 |
| 937806 | N/A | N/A | 58825 | 58844 | CACACAGTATTTTTTATCG | 72 | 2581 |
| 937818 | N/A | N/A | 61266 | 61285 | CTACTTGTTTTACTTAAACC | 86 | 2582 |
| 937830 | N/A | N/A | 67096 | 67115 | TCCAGAAAAGTTTAATGCAT | 94 | 2583 |
| 937842 | N/A | N/A | 69104 | 69123 | GAGTTCTATAGGTGCTTAAG | 30 | 2584 |
| 937854 | N/A | N/A | 71512 | 71531 | CTATATAAAGTATCAGTATA | 153 | 2585 |
| 937866 | N/A | N/A | 73688 | 73707 | AACCTACCTTAAGATCCTGA | 86 | 2586 |
| 937878 | N/A | N/A | 74727 | 74746 | AAGTTCAGGCCCTACAGTAT | 87 | 2587 |
| 937890 | N/A | N/A | 81996 | 82015 | GGATTGCTCACCGTGATATA | 30 | 2588 |
| 937902 | N/A | N/A | 82458 | 82477 | GTCTCAGCCAGTCCTCAATG | 39 | 2589 |
| 937914 | N/A | N/A | 82854 | 82873 | TTTCATGGCTCCAATATCGG | 39 | 2590 |
| 937926 | N/A | N/A | 83415 | 83434 | TGGTCAAAATACTTGCCTCC | 95 | 2591 |
| 937938 | N/A | N/A | 83790 | 83809 | GTTGCACATAGGTTAGAATT | 12 | 2592 |
| 937950 | N/A | N/A | 84162 | 84181 | CACTCTTTTCCCACAAAGTT | 57 | 2593 |
| 937962 | N/A | N/A | 84408 | 84427 | AGTATCATATATTTCTCAGC | 20 | 2594 |
| 937974 | N/A | N/A | 84755 | 84774 | TGGAATCTTATTAAGCAAGT | 28 | 2595 |
| 937986 | N/A | N/A | 84812 | 84831 | TTCCTTACAATTATCTATGA | 56 | 2596 |
| 937998 | N/A | N/A | 85050 | 85069 | TTAATTAGGATCTATACACA | 75 | 2597 |
| 938010 | N/A | N/A | 85181 | 85200 | CATTTTAACCCTTTGAGGAC | 83 | 2598 |
| 938022 | N/A | N/A | 92150 | 92169 | AGTAATGCTTATTTTCTAAA | 40 | 2599 |
| 938034 | N/A | N/A | 96348 | 96367 | AAACAGTATTTTCTTAGATA | 104 | 2600 |
| 938046 | N/A | N/A | 97625 | 97644 | AGATAAGACTTTTTATGTTG | 58 | 2601 |
| 938058 | N/A | N/A | 99151 | 99170 | TTAACTCATGGCAACCACCG | 86 | 2602 |
| 938070 | N/A | N/A | 104058 | 104077 | TACATCTTAACAGAATAAAA | 95 | 2603 |
| 938082 | N/A | N/A | 109341 | 109360 | CCCTCTAATGCATGTATGGC | 76 | 2604 |
| 938094 | N/A | N/A | 112723 | 112742 | ACTATAAACTAACAATAACA | 88 | 2605 |

TABLE 35-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 938106 | N/A | N/A | 119023 | 119042 | CCCATTGCATTGTTTTAAGT | 30 | 2606 |
| 938118 | N/A | N/A | 120014 | 120033 | TGAAAATCTAAGGCCACATG | 87 | 2607 |
| 938130 | N/A | N/A | 124891 | 124910 | AGTATATGATGACCTCAATG | 36 | 2608 |
| 938142 | N/A | N/A | 127923 | 127942 | ACTCCTCACTGAAAGTACAC | 76 | 2609 |
| 938154 | N/A | N/A | 129793 | 129812 | CTTTGTTACTTATTACCTTC | 40 | 2610 |
| 938166 | N/A | N/A | 132157 | 132176 | ATTATTCTCACATATAAATA | 118 | 2611 |
| 938178 | N/A | N/A | 132322 | 132341 | TTTGAAGCAATCCATTAATT | 67 | 2612 |
| 938190 | N/A | N/A | 132527 | 132546 | TGCCCATGTAGTTACATGTA | 64 | 2613 |
| 938202 | N/A | N/A | 134160 | 134179 | AAGGGAATCTTGATTAACTA | 48 | 2614 |
| 938214 | N/A | N/A | 136587 | 136606 | CACACAATTTTGCAAAAACA | 77 | 2615 |
| 938226 | N/A | N/A | 138442 | 138461 | TGACAATATTAATGGCACAA | 23 | 2616 |
| 938238 | N/A | N/A | 139274 | 139293 | TGTGTTTAATTTGTAACTAG | 21 | 2617 |
| 938250 | N/A | N/A | 142909 | 142928 | AGCACAGCTTTGGGAAGAGG | 44 | 2618 |
| 938262 | N/A | N/A | 145801 | 145820 | TCCCATGACAAAACCACACA | 81 | 2619 |
| 938274 | N/A | N/A | 146800 | 146819 | CCAGCCTCTGGTAGACACCT | 68 | 2620 |

TABLE 36

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 20 | 32 |
| 937366 | 1563 | 1582 | 81723 | 81742 | CTGCTGTGTATTTTTCTTCC | 21 | 2621 |
| 937378 | 3492 | 3511 | 136965 | 136984 | TTGTCTCCTTGTTGTATGGT | 14 | 2622 |
| 937390 | 4403 | 4422 | 149154 | 149173 | AGCTGATGTGTTCATGACTT | 29 | 2623 |
| 937413 | N/A | N/A | 3946 | 3965 | ACTACAACCCCGGCTTAGGA | 65 | 2624 |
| 937425 | N/A | N/A | 4529 | 4548 | AGTAGTGTTTGGGATGCTTC | 14 | 2625 |
| 937437 | N/A | N/A | 4750 | 4769 | ATGCAACTTAATAACCTTAG | 12 | 2626 |
| 937449 | N/A | N/A | 6321 | 6340 | CCCAACAATAGAATGGTTAA | 87 | 2627 |
| 937461 | N/A | N/A | 7550 | 7569 | TAGGCTGGTAATTTAATGTC | 40 | 2628 |
| 937473 | N/A | N/A | 9934 | 9953 | AAGCTTAGAGTTTTTGCCTT | 38 | 2629 |
| 937485 | N/A | N/A | 10354 | 10373 | TACACAGCATGATCTTGTGT | 85 | 2630 |
| 937497 | N/A | N/A | 14749 | 14768 | TACTTGCTGCCAATATGTAC | 83 | 2631 |
| 937509 | N/A | N/A | 17159 | 17178 | TTTTGAATTACAATGCGGTA | 14 | 2632 |
| 937521 | N/A | N/A | 18685 | 18704 | CGGCCAGTATCTCAGTTTTT | 90 | 2633 |

TABLE 36-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 937533 | N/A | N/A | 19935 | 19954 | TGTGCGCATCATTACGACCA | 79 | 2634 |
| 937545 | N/A | N/A | 23252 | 23271 | CTGTATTTTACTCACCTTT | 32 | 2635 |
| 937557 | N/A | N/A | 26110 | 26129 | AGTAAACATCAGCATCTCAA | 30 | 2636 |
| 937569 | N/A | N/A | 28080 | 28099 | AGACTTTGAAATCTCACAAG | 45 | 2637 |
| 937581 | N/A | N/A | 28496 | 28515 | CACCGGATTGTTTTCTTCAT | 33 | 2638 |
| 937593 | N/A | N/A | 28891 | 28910 | GAAGTCTTGTTCAGTGTCCT | 8 | 2639 |
| 937605 | N/A | N/A | 31491 | 31510 | TTCATATCACCTCTGACTTA | 76 | 2640 |
| 937617 | N/A | N/A | 32745 | 32764 | TGAATATTTTCTCCCTAAAA | 72 | 2641 |
| 937629 | N/A | N/A | 32806 | 32825 | ATTTCAGACTTCTTGTTGTT | 44 | 2642 |
| 937641 | N/A | N/A | 32819 | 32838 | TTTTGTTCTTCCAATTTCAG | 40 | 2643 |
| 937653 | N/A | N/A | 36308 | 36327 | TCTTTGCGCCTGTGTCACAT | 31 | 2644 |
| 937665 | N/A | N/A | 36847 | 36866 | AGTATTTACTACTTCTGCAT | 34 | 2645 |
| 937677 | N/A | N/A | 37662 | 37681 | TGAAAATCAGAAAATGATGC | 80 | 2646 |
| 937689 | N/A | N/A | 41279 | 41298 | TTTATGAGGGACTAGAGCAT | 68 | 2647 |
| 937701 | N/A | N/A | 44118 | 44137 | AAGTACTTCACATGCAACAT | 48 | 2648 |
| 937713 | N/A | N/A | 47686 | 47705 | CAGAGGACCAACTGTACTTT | 49 | 2649 |
| 937725 | N/A | N/A | 48823 | 48842 | GTGGCTTTAAAAACTAGGTA | 13 | 2650 |
| 937737 | N/A | N/A | 49151 | 49170 | GCTCATCAAGGTACCAGTTC | 15 | 2651 |
| 937749 | N/A | N/A | 50060 | 50079 | TCTTCCTTAGCCTTATACTT | 71 | 2652 |
| 937761 | N/A | N/A | 51975 | 51994 | AGAGACCTGATGTCCTAAAC | 53 | 2653 |
| 937773 | N/A | N/A | 55203 | 55222 | ATAGCTATGCTACAATAAAA | 97 | 2654 |
| 937785 | N/A | N/A | 57319 | 57338 | ATTCTTTCCATAAAATAATG | 96 | 2655 |
| 937797 | N/A | N/A | 58028 | 58047 | ACAATTATTTGCATCGCTGA | 61 | 2656 |
| 937809 | N/A | N/A | 60472 | 60491 | TTATTTATCAGTGTGAAGTA | 67 | 2657 |
| 937821 | N/A | N/A | 61630 | 61649 | CCCTGGCAAATATGTAAAAC | 88 | 2658 |
| 937833 | N/A | N/A | 67676 | 67695 | TTTAATCATTGTCTATGGTA | 83 | 2659 |
| 937845 | N/A | N/A | 69108 | 69127 | AACTGAGTTCTATAGGTGCT | 42 | 2660 |
| 937857 | N/A | N/A | 71901 | 71920 | ATAATGCCTCTGAAAAATCA | 107 | 2661 |
| 937869 | N/A | N/A | 73968 | 73987 | GAGCAGCAGGACTCAGCTGG | 95 | 2662 |
| 937881 | N/A | N/A | 75978 | 75997 | TTAAGCCACACGAAGCATTT | 72 | 2663 |
| 937893 | N/A | N/A | 82143 | 82162 | ACTCTACAGGTTATGCTAGC | 66 | 2664 |
| 937905 | N/A | N/A | 82586 | 82605 | TCCTCTCTCTCTTACCAGTA | 50 | 2665 |
| 937917 | N/A | N/A | 82857 | 82876 | GTTTTTCATGGCTCCAATAT | 38 | 2666 |
| 937929 | N/A | N/A | 83495 | 83514 | CACATTCATATCAGTTATGT | 25 | 2667 |
| 937941 | N/A | N/A | 83793 | 83812 | AGTGTTGCACATAGGTTAGA | 17 | 2668 |
| 937953 | N/A | N/A | 84288 | 84307 | ACTCAAGAGTGTCCATTTGG | 41 | 2669 |

TABLE 36-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 937965 | N/A | N/A | 84412 | 84431 | CTTAAGTATCATATATTTCT | 78 | 2670 |
| 937977 | N/A | N/A | 84759 | 84778 | AGTTTGGAATCTTATTAAGC | 37 | 2671 |
| 937989 | N/A | N/A | 84817 | 84836 | GCTGGTTCCTTACAATTATC | 10 | 2672 |
| 938001 | N/A | N/A | 85053 | 85072 | GGGTTAATTAGGATCTATAC | 23 | 2673 |
| 938013 | N/A | N/A | 85185 | 85204 | TGTACATTTTAACCCTTTGA | 61 | 2674 |
| 938025 | N/A | N/A | 92639 | 92658 | ATTGGTTGGTCTCAAAATCT | 34 | 2675 |
| 938037 | N/A | N/A | 97581 | 97600 | CATTAATGAAGGTTTACAGA | 58 | 2676 |
| 938049 | N/A | N/A | 98156 | 98175 | AAACATAAGAGAATAACATT | 94 | 2677 |
| 938061 | N/A | N/A | 99778 | 99797 | GCATTCTTACTATGGGTTG | 28 | 2678 |
| 938073 | N/A | N/A | 105409 | 105428 | ATAACACTAGAGGCCGGGCA | 85 | 2679 |
| 938085 | N/A | N/A | 109978 | 109997 | AGGGAAATACCTAGTCCTAG | 71 | 2680 |
| 938097 | N/A | N/A | 117276 | 117295 | TATCAGGCATGGAGCCACTG | 71 | 2681 |
| 938109 | N/A | N/A | 119026 | 119045 | GTTCCCATTGCATTGTTTTA | 28 | 2682 |
| 938121 | N/A | N/A | 122563 | 122582 | CCAATTCTAGGTATTTAACT | 56 | 2683 |
| 938133 | N/A | N/A | 125211 | 125230 | AGTAATGCACCAGTACAATA | 36 | 2684 |
| 938145 | N/A | N/A | 129289 | 129308 | CCAATACCTCAAAGGATTGG | 132 | 2685 |
| 938157 | N/A | N/A | 130202 | 130221 | TTCCTCACACATTTCTTACA | 75 | 2686 |
| 938169 | N/A | N/A | 132160 | 132179 | CTTATTATTCTCACATATAA | 61 | 2687 |
| 938181 | N/A | N/A | 132517 | 132536 | GTTACATGTAACCATAATCT | 51 | 2688 |
| 938193 | N/A | N/A | 133242 | 133261 | TTGAAAGTGATAATGTGGAA | 40 | 2689 |
| 938205 | N/A | N/A | 134816 | 134835 | ATGATGTAGCTTAAAAAGAA | 86 | 2690 |
| 938217 | N/A | N/A | 137025 | 137044 | ACTGTACAATTAAAAATTAG | 93 | 2691 |
| 938229 | N/A | N/A | 138943 | 138962 | ATTAAGGACCTTAGCTACTT | 93 | 2692 |
| 938241 | N/A | N/A | 139366 | 139385 | ATCAGTCAAAAATCCTTAAT | 60 | 2693 |
| 938253 | N/A | N/A | 143542 | 143561 | AACCTTGGTACAAAACCAT | 77 | 2694 |
| 938265 | N/A | N/A | 146161 | 146180 | CAATGTCCAAGGCCAAGCCC | 99 | 2695 |
| 938277 | N/A | N/A | 147075 | 147094 | AAAGGTGATTTTAGTCAGCC | 43 | 2696 |

TABLE 37

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 20 | 32 |
| 760800 | 4404 | 4423 | 149155 | 149174 | TAGCTGATGTGTTCATGACT | 36 | 2697 |
| 937367 | 1564 | 1583 | 81724 | 81743 | ACTGCTGTGTATTTTCTTC | 32 | 2698 |

TABLE 37-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 937379 | 3941 | 3960 | 147856 | 147875 | CATTGGCGCATGGGCAGTTG | 62 | 2699 |
| 937414 | N/A | N/A | 4008 | 4027 | TGCACAAACACACCCTCGAG | 85 | 2700 |
| 937426 | N/A | N/A | 4531 | 4550 | TAAGTAGTGTTTGGGATGCT | 18 | 2701 |
| 937438 | N/A | N/A | 4751 | 4770 | AATGCAACTTAATAACCTTA | 30 | 2702 |
| 937450 | N/A | N/A | 6450 | 6469 | CTGAAGCCCTCTGAACTAGT | 63 | 2703 |
| 937462 | N/A | N/A | 8171 | 8190 | CATTGCTAATTAGAGTAACA | 45 | 2704 |
| 937474 | N/A | N/A | 9935 | 9954 | AAAGCTTAGAGTTTTTGCCT | 16 | 2705 |
| 937486 | N/A | N/A | 10355 | 10374 | ATACACAGCATGATCTTGTG | 62 | 2706 |
| 937498 | N/A | N/A | 14825 | 14844 | GTCTTTCAACTTTCTATCAC | 45 | 2707 |
| 937510 | N/A | N/A | 17160 | 17179 | ATTTTGAATTACAATGCGGT | 13 | 2708 |
| 937522 | N/A | N/A | 19099 | 19118 | AATAAGCCATGATCACAATA | 68 | 2709 |
| 937534 | N/A | N/A | 19980 | 19999 | GGCCTATGCCTTTACCGCCA | 51 | 2710 |
| 937546 | N/A | N/A | 23254 | 23273 | CGCTGTATTTTTACTCACCT | 14 | 2711 |
| 937558 | N/A | N/A | 26524 | 26543 | TCAGAAAGCTTCTCAAACAT | 52 | 2712 |
| 937570 | N/A | N/A | 28081 | 28100 | AAGACTTTGAAATCTCACAA | 27 | 2713 |
| 937582 | N/A | N/A | 28497 | 28516 | TCACCGGATTGTTTTCTTCA | 24 | 2714 |
| 937594 | N/A | N/A | 28892 | 28911 | TGAAGTCTTGTTCAGTGTCC | 23 | 2715 |
| 937606 | N/A | N/A | 32324 | 32343 | TCCATACAGATCGCATAGCT | 33 | 2716 |
| 937618 | N/A | N/A | 32792 | 32811 | GTTGTTGTTTACATTATTAT | 9 | 2717 |
| 937630 | N/A | N/A | 32807 | 32826 | AATTTCAGACTTCTTGTTGT | 42 | 2718 |
| 937642 | N/A | N/A | 32820 | 32839 | ATTTTGTTCTTCCAATTTCA | 46 | 2719 |
| 937654 | N/A | N/A | 36309 | 36328 | CTCTTTGCGCCTGTGTCACA | 31 | 2720 |
| 937666 | N/A | N/A | 36848 | 36867 | CAGTATTTACTACTTCTGCA | 15 | 2721 |
| 937678 | N/A | N/A | 37789 | 37808 | TTCGATTATCTCAATCAAAT | 63 | 2722 |
| 937690 | N/A | N/A | 41280 | 41299 | TTTTATGAGGGACTAGAGCA | 52 | 2723 |
| 937702 | N/A | N/A | 44143 | 44162 | TTACTACAAAACCAGACACC | 91 | 2724 |
| 937714 | N/A | N/A | 47706 | 47725 | GAATATGGAACCCACAGATG | 71 | 2725 |
| 937726 | N/A | N/A | 48843 | 48862 | GAGAAGTAAAATCATTCAAA | 56 | 2726 |
| 937738 | N/A | N/A | 49153 | 49172 | TAGCTCATCAAGGTACCAGT | 8 | 2727 |
| 937750 | N/A | N/A | 50130 | 50149 | GTATGTTCTACTTCTTCACC | 27 | 2728 |
| 937762 | N/A | N/A | 52329 | 52348 | GAAAACCATGCGGCCTGGCC | 87 | 2729 |
| 937774 | N/A | N/A | 55204 | 55223 | CATAGCTATGCTACAATAAA | 77 | 2730 |
| 937786 | N/A | N/A | 57389 | 57408 | GGAACACATCCCAGAGCTCT | 45 | 2731 |
| 937798 | N/A | N/A | 58348 | 58367 | AAGACCAAAAAGACAACCAT | 122 | 2732 |
| 937810 | N/A | N/A | 60507 | 60526 | GTTTAATCACAGTTTTCTCA | 24 | 2733 |
| 937822 | N/A | N/A | 62506 | 62525 | GGAGGAAAAGCTAGCTACCT | 99 | 2734 |

TABLE 37-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 937834 | N/A | N/A | 68516 | 68535 | AAAGCAGGATGCTACAACGC | 104 | 2735 |
| 937846 | N/A | N/A | 69109 | 69128 | TAACTGAGTTCTATAGGTGC | 48 | 2736 |
| 937858 | N/A | N/A | 71938 | 71957 | TCAGCTTCTCAATCTTTCCT | 45 | 2737 |
| 937870 | N/A | N/A | 74037 | 74056 | CTCCACCAGCAGCACTACTC | 91 | 2738 |
| 937882 | N/A | N/A | 76079 | 76098 | TACGGAATATATAGTATTCA | 115 | 2739 |
| 937894 | N/A | N/A | 82205 | 82224 | TAAGTGTCAAAGACCCTATT | 111 | 2740 |
| 937906 | N/A | N/A | 82655 | 82674 | ACAAGCCCACATATGCAATT | 55 | 2741 |
| 937918 | N/A | N/A | 82867 | 82886 | CTGTTCTTTGGTTTTTCATG | 16 | 2742 |
| 937930 | N/A | N/A | 83743 | 83762 | TTATTATCCAGTGTTTTTAA | 39 | 2743 |
| 937942 | N/A | N/A | 83794 | 83813 | CAGTGTTGCACATAGGTTAG | 14 | 2744 |
| 937954 | N/A | N/A | 84317 | 84336 | TTTCACCCCCAATATTAAGT | 33 | 2745 |
| 937966 | N/A | N/A | 84439 | 84458 | GGTCTCCTCTCCATAGGGTT | 69 | 2746 |
| 937978 | N/A | N/A | 84760 | 84779 | CAGTTTGGAATCTTATTAAG | 38 | 2747 |
| 937990 | N/A | N/A | 84818 | 84837 | TGCTGGTTCCTTACAATTAT | 23 | 2748 |
| 938002 | N/A | N/A | 85055 | 85074 | AAGGGTTAATTAGGATCTAT | 23 | 2749 |
| 938014 | N/A | N/A | 85186 | 85205 | TTGTACATTTTAACCCTTTG | 24 | 2750 |
| 938026 | N/A | N/A | 92676 | 92695 | ATTTTCCTTTCTAAGAAGCT | 109 | 2751 |
| 938038 | N/A | N/A | 97616 | 97635 | TTTTTATGTTGCTCCTTCTT | 60 | 2752 |
| 938050 | N/A | N/A | 98179 | 98198 | TGGTACACAGGAAATACGCA | 51 | 2753 |
| 938062 | N/A | N/A | 99876 | 99895 | TGCCAAGGACTTCGGAGTTT | 41 | 2754 |
| 938074 | N/A | N/A | 105836 | 105855 | GCTCTCAAAGATAGACCCTA | 47 | 2755 |
| 938086 | N/A | N/A | 110157 | 110176 | GCTCACAGCTCTGGGAGGAG | 76 | 2756 |
| 938098 | N/A | N/A | 117437 | 117456 | ATCTAGCAAACCCTCTTCTT | 84 | 2757 |
| 938110 | N/A | N/A | 119027 | 119046 | AGTTCCCATTGCATTGTTTT | 25 | 2758 |
| 938122 | N/A | N/A | 122999 | 123018 | ATCAGTTGGAATGTAAAATG | 42 | 2759 |
| 938134 | N/A | N/A | 125248 | 125267 | TAAAAATGGGAGCATGGCAA | 72 | 2760 |
| 938146 | N/A | N/A | 129750 | 129769 | AAAGCTAGTCAAGTATACTA | 78 | 2761 |
| 938158 | N/A | N/A | 130244 | 130263 | CCAGTTCCTCCAGCACGAGC | 60 | 2762 |
| 938170 | N/A | N/A | 132161 | 132180 | GCTTATTATTCTCACATATA | 8 | 2763 |
| 938182 | N/A | N/A | 132518 | 132537 | AGTTACATGTAACCATAATC | 41 | 2764 |
| 938194 | N/A | N/A | 133369 | 133388 | ATAAACCAAGTTAGTTTGTC | 35 | 2765 |
| 938206 | N/A | N/A | 134853 | 134872 | TTCTTCTGTTTGCATTAAAT | 53 | 2766 |
| 938218 | N/A | N/A | 137049 | 137068 | CATGTAT CCTTTAAAAGTG | 72 | 2767 |
| 938230 | N/A | N/A | 139050 | 139069 | AAGCAGCAGATTAAATTAGC | 70 | 2768 |
| 938242 | N/A | N/A | 139497 | 139516 | AAAACTTTAGTCTTCATAAA | 110 | 2769 |
| 938254 | N/A | N/A | 143622 | 143641 | GGACAACATGATGGGCCAGT | 62 | 2770 |

TABLE 37-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 938266 | N/A | N/A | 146188 | 146207 | TGCTTCCAGCTTCTAGTTAC | 55 | 2771 |
| 938278 | N/A | N/A | 147266 | 147285 | CACCAGGCAGTGAAAAGAGA | 93 | 2772 |

TABLE 38

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 19 | 32 |
| 937368 | 1565 | 1584 | 81725 | 81744 | AACTGCTGTGTATTTTCTT | 45 | 2773 |
| 937380 | 3949 | 3968 | 147864 | 147883 | ATTAGCATCATTGGCGCATG | 54 | 2774 |
| 937391 | 4405 | 4424 | 149156 | 149175 | CTAGCTGATGTGTTCATGAC | 48 | 2775 |
| 937415 | N/A | N/A | 4045 | 4064 | GAACTGACAACCGCCCGCCA | 30 | 2776 |
| 937427 | N/A | N/A | 4532 | 4551 | CTAAGTAGTGTTTGGGATGC | 21 | 2777 |
| 937439 | N/A | N/A | 4752 | 4771 | CAATGCAACTTAATAACCTT | 28 | 2778 |
| 937451 | N/A | N/A | 6471 | 6490 | CTAGCAAGAGCCATAAAAAT | 78 | 2779 |
| 937463 | N/A | N/A | 8194 | 8213 | ATCCCTTATGTAGAAGTATA | 40 | 2780 |
| 937475 | N/A | N/A | 9937 | 9956 | TCAAAGCTTAGAGTTTTTGC | 38 | 2781 |
| 937487 | N/A | N/A | 10383 | 10402 | TAAAAAGGTTGAGGACCATT | 62 | 2782 |
| 937499 | N/A | N/A | 15807 | 15826 | TGGTATACTTGTTGAGCTCT | 36 | 2783 |
| 937511 | N/A | N/A | 17161 | 17180 | CATTTTGAATTACAATGCGG | 19 | 2784 |
| 937523 | N/A | N/A | 19683 | 19702 | ACCAGAGCCATTCCAACTCC | 60 | 2785 |
| 937535 | N/A | N/A | 19992 | 20011 | GATCAGGGCCCAGGCCTATG | 75 | 2786 |
| 937547 | N/A | N/A | 23255 | 23274 | ACGCTGTATTTTTACTCACC | 8 | 2787 |
| 937559 | N/A | N/A | 26624 | 26643 | TGTATGCCCTGGGAGAATAA | 67 | 2788 |
| 937571 | N/A | N/A | 28083 | 28102 | CAAAGACTTTGAAATCTCAC | 35 | 2789 |
| 937583 | N/A | N/A | 28498 | 28517 | ATCACCGGATTGTTTCTTC | 25 | 2790 |
| 937595 | N/A | N/A | 28893 | 28912 | CTGAAGTCTTGTTCAGTGTC | 21 | 2791 |
| 937607 | N/A | N/A | 32325 | 32344 | TTCCATACAGATCGCATAGC | 46 | 2792 |
| 937619 | N/A | N/A | 32793 | 32812 | TGTTGTTGTTTACATTATTA | 9 | 2793 |
| 937631 | N/A | N/A | 32808 | 32827 | CAATTTCAGACTTCTTGTTG | 44 | 2794 |
| 937643 | N/A | N/A | 33044 | 33063 | CCCTCCAGCTATTCACATGG | 87 | 2795 |
| 937655 | N/A | N/A | 36310 | 36329 | TCTCTTTGCGCCTGTGTCAC | 26 | 2796 |
| 937667 | N/A | N/A | 36849 | 36868 | TCAGTATTTACTACTTCTGC | 28 | 2797 |
| 937679 | N/A | N/A | 37799 | 37818 | GAAGTCTTCCTTCGATTATC | 32 | 2798 |

TABLE 38-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 937691 | N/A | N/A | 41281 | 41300 | ATTTTATGAGGGACTAGAGC | 44 | 2799 |
| 937703 | N/A | N/A | 44743 | 44762 | TCATTTCTAAATAATATGCG | 90 | 2800 |
| 937715 | N/A | N/A | 48108 | 48127 | TTGGTTCAGACGCAACCATG | 129 | 2801 |
| 937727 | N/A | N/A | 48856 | 48875 | AGTATTTGAAACTGAGAAGT | 66 | 2802 |
| 937739 | N/A | N/A | 49154 | 49173 | TTAGCTCATCAAGGTACCAG | 15 | 2803 |
| 937751 | N/A | N/A | 50210 | 50229 | GACTAAATTTTAATATAAC | 88 | 2804 |
| 937763 | N/A | N/A | 52397 | 52416 | AGTAAGTCTCTAATAAAAAA | 96 | 2805 |
| 937775 | N/A | N/A | 55360 | 55379 | GCAGCGGAAAATATGATTTA | 64 | 2806 |
| 937787 | N/A | N/A | 57465 | 57484 | TTCACTAGGTTCTCAAAAGG | 84 | 2807 |
| 937799 | N/A | N/A | 58355 | 58374 | CACTATCAAGACCAAAAAGA | 113 | 2808 |
| 937811 | N/A | N/A | 60508 | 60527 | TGTTTAATCACAGTTTTCTC | 51 | 2809 |
| 937823 | N/A | N/A | 62624 | 62643 | AAGATCAAAAGAAGTTTTAG | 89 | 2810 |
| 937835 | N/A | N/A | 68567 | 68586 | AAAAGCATTCTGGAAGAGAA | 98 | 2811 |
| 937847 | N/A | N/A | 69110 | 69129 | TTAACTGAGTTCTATAGGTG | 53 | 2812 |
| 937859 | N/A | N/A | 72175 | 72194 | TAGCAGGCGATGTTGGAGGA | 131 | 2813 |
| 937871 | N/A | N/A | 74117 | 74136 | TAGGTGTGGGTAGGTATGAG | 86 | 2814 |
| 937883 | N/A | N/A | 76109 | 76128 | TATGTGAAGATAAACTGCTA | 73 | 2815 |
| 937895 | N/A | N/A | 82215 | 82234 | AACTCTTCTCTAAGTGTCAA | 79 | 2816 |
| 937907 | N/A | N/A | 82806 | 82825 | GCCAGTCTCACAGTGTCAAC | 27 | 2817 |
| 937919 | N/A | N/A | 82878 | 82897 | TCTCTCACTGGCTGTTCTTT | 64 | 2818 |
| 937931 | N/A | N/A | 83773 | 83792 | ATTTTCCATATAAATTATGT | 94 | 2819 |
| 937943 | N/A | N/A | 83804 | 83823 | ATATTAACCACAGTGTTGCA | 41 | 2820 |
| 937955 | N/A | N/A | 84347 | 84366 | ACTAAAATCTTTCCTCAGTG | 70 | 2821 |
| 937967 | N/A | N/A | 84579 | 84598 | TCTAAGCGACTGCTTAATAA | 78 | 2822 |
| 937979 | N/A | N/A | 84761 | 84780 | TCAGTTTGGAATCTTATTAA | 33 | 2823 |
| 937991 | N/A | N/A | 84819 | 84838 | ATGCTGGTTCCTTACAATTA | 19 | 2824 |
| 938003 | N/A | N/A | 85057 | 85076 | CAAAGGGTTAATTAGGATCT | 33 | 2825 |
| 938015 | N/A | N/A | 85187 | 85206 | CTTGTACATTTTAACCCTTT | 22 | 2826 |
| 938027 | N/A | N/A | 95247 | 95266 | TACACTTTAAACGGTTTATT | 54 | 2827 |
| 938039 | N/A | N/A | 97617 | 97636 | CTTTTTATGTTGCTCCTTCT | 45 | 2828 |
| 938051 | N/A | N/A | 98329 | 98348 | GCCCTCTTACTTACTAGCCA | 67 | 2829 |
| 938063 | N/A | N/A | 99878 | 99897 | ATTGCCAAGGACTTCGGAGT | 55 | 2830 |
| 938075 | N/A | N/A | 105916 | 105935 | CAAATAGGCCCAATACATAT | 93 | 2831 |
| 938087 | N/A | N/A | 110707 | 110726 | AATTGTCCATCCCAGTGATT | 98 | 2832 |
| 938099 | N/A | N/A | 117523 | 117542 | GTTGCCCCTCTGCTTCAAAA | 57 | 2833 |
| 938111 | N/A | N/A | 119029 | 119048 | AAAGTTCCCATTGCATTGTT | 31 | 2834 |

TABLE 38-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 938123 | N/A | N/A | 123079 | 123098 | GACCTGTTGAAATTAAAAAG | 91 | 2835 |
| 938135 | N/A | N/A | 125729 | 125748 | GAATTACATTATTATCTATC | 50 | 2836 |
| 938147 | N/A | N/A | 129785 | 129804 | CTTATTACCTTCCTGTATAT | 117 | 2837 |
| 938159 | N/A | N/A | 130324 | 130343 | TCTGCATGTAAGGGCCTCGC | 53 | 2838 |
| 938171 | N/A | N/A | 132163 | 132182 | TTGCTTATTATTCTCACATA | 19 | 2839 |
| 938183 | N/A | N/A | 132519 | 132538 | TAGTTACATGTAACCATAAT | 54 | 2840 |
| 938195 | N/A | N/A | 133470 | 133489 | ATAAAAGCCAGCATGATAAA | 64 | 2841 |
| 938207 | N/A | N/A | 134941 | 134960 | CTATGTTTTCAATGCCTTTG | 21 | 2842 |
| 938219 | N/A | N/A | 137245 | 137264 | AAAATATTAGGCATTTCCCA | 44 | 2843 |
| 938231 | N/A | N/A | 139266 | 139285 | ATTTGTAACTAGGTTTTGTC | 74 | 2844 |
| 938243 | N/A | N/A | 139545 | 139564 | AATTTTATTTGTAATACTGA | 121 | 2845 |
| 938255 | N/A | N/A | 143628 | 143647 | TTCAAAGGACAACATGATGG | 82 | 2846 |
| 938267 | N/A | N/A | 146379 | 146398 | CTTCAGTGCAGCTCCTTCTC | 55 | 2847 |
| 938279 | N/A | N/A | 147364 | 147383 | AAACAGATTACATTAATAAG | 86 | 2848 |

TABLE 39

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 17 | 32 |
| 937369 | 1566 | 1585 | 81726 | 81745 | GAACTGCTGTGTATTTTTCT | 28 | 2849 |
| 937381 | 3952 | 3971 | 147867 | 147886 | GTCATTAGCATCATTGGCGC | 87 | 2850 |
| 937392 | 4406 | 4425 | 149157 | 149176 | GCTAGCTGATGTGTTCATGA | 60 | 2851 |
| 937416 | N/A | N/A | 4090 | 4109 | CCTTCTCCCTTTGAACACTA | 37 | 2852 |
| 937428 | N/A | N/A | 4533 | 4552 | GCTAAGTAGTGTTTGGGATG | 14 | 2853 |
| 937440 | N/A | N/A | 4753 | 4772 | TCAATGCAACTTAATAACCT | 55 | 2854 |
| 937452 | N/A | N/A | 6571 | 6590 | CCCACAATATTTGACAAACT | 70 | 2855 |
| 937464 | N/A | N/A | 8607 | 8626 | GCTGTAGCTATTTAGGACAA | 24 | 2856 |
| 937476 | N/A | N/A | 10130 | 10149 | ATGTTAGCCAGCTGGTGTAC | 97 | 2857 |
| 937488 | N/A | N/A | 10400 | 10419 | AAACCGGTCCCTAGTGTTAA | 91 | 2858 |
| 937500 | N/A | N/A | 16473 | 16492 | AGTAATGCCCTTAGGGCCTA | 76 | 2859 |
| 937512 | N/A | N/A | 17162 | 17181 | ACATTTGAATTACAATGCG | 19 | 2860 |
| 937524 | N/A | N/A | 19836 | 19855 | CCCGTGATCTGATTCCCATG | 71 | 2861 |
| 937536 | N/A | N/A | 20207 | 20226 | ATGCTCAAGGAGGAGCAAGA | 104 | 2862 |
| 937548 | N/A | N/A | 23256 | 23275 | TACGCTGTATTTTACTCAC | 36 | 2863 |

TABLE 39-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 937560 | N/A | N/A | 26628 | 26647 | ATTATGTATGCCCTGGGAGA | 58 | 2864 |
| 937572 | N/A | N/A | 28084 | 28103 | GCAAAGACTTTGAAATCTCA | 11 | 2865 |
| 937584 | N/A | N/A | 28499 | 28518 | AATCACCGGATTGTTTTCTT | 28 | 2866 |
| 937596 | N/A | N/A | 28894 | 28913 | GCTGAAGTCTTGTTCAGTGT | 66 | 2867 |
| 937608 | N/A | N/A | 32326 | 32345 | ATTCCATACAGATCGCATAG | 37 | 2868 |
| 937620 | N/A | N/A | 32796 | 32815 | TCTTGTTGTTGTTTACATTA | 11 | 2869 |
| 937632 | N/A | N/A | 32809 | 32828 | CCAATTTCAGACTTCTTGTT | 28 | 2870 |
| 937644 | N/A | N/A | 33050 | 33069 | GCTCTTCCCTCCAGCTATTC | 44 | 2871 |
| 937656 | N/A | N/A | 36311 | 36330 | CTCTCTTTGCGCCTGTGTCA | 24 | 2872 |
| 937668 | N/A | N/A | 36851 | 36870 | AATCAGTATTTACTACTTCT | 25 | 2873 |
| 937680 | N/A | N/A | 38003 | 38022 | TACAGGTGAGATATATAGGA | 9 | 2874 |
| 937692 | N/A | N/A | 41282 | 41301 | CATTTTATGAGGGACTAGAG | 63 | 2875 |
| 937704 | N/A | N/A | 45245 | 45264 | ACCAATCACTGTTATAAAGA | 42 | 2876 |
| 937716 | N/A | N/A | 48164 | 48183 | AAATTGTCATACTGTATTGT | 60 | 2877 |
| 937728 | N/A | N/A | 48887 | 48906 | CTGATTACACAAACCAGTCT | 73 | 2878 |
| 937740 | N/A | N/A | 49155 | 49174 | TTTAGCTCATCAAGGTACCA | 64 | 2879 |
| 937752 | N/A | N/A | 50666 | 50685 | TGGCATATACAAATAAATAA | 57 | 2880 |
| 937764 | N/A | N/A | 52516 | 52535 | TTAAACCAGGATCCCTAGAA | 93 | 2881 |
| 937776 | N/A | N/A | 55427 | 55446 | CACATTCTGTTACTTCACCA | 57 | 2882 |
| 937788 | N/A | N/A | 57466 | 57485 | TTTCACTAGGTTCTCAAAAG | 93 | 2883 |
| 937800 | N/A | N/A | 58468 | 58487 | ACACATATCTGTGTCTTAAT | 67 | 2884 |
| 937812 | N/A | N/A | 60509 | 60528 | TTGTTTAATCACAGTTTTCT | 49 | 2885 |
| 937824 | N/A | N/A | 63522 | 63541 | CTCCCTATCTCAAATGAATG | 105 | 2886 |
| 937836 | N/A | N/A | 68773 | 68792 | TGCTGAACTCTTCTGAGGCT | 98 | 2887 |
| 937848 | N/A | N/A | 69111 | 69130 | ATTAACTGAGTTCTATAGGT | 51 | 2888 |
| 937860 | N/A | N/A | 72338 | 72357 | AAAAGCATTGTAACAACAAG | 77 | 2889 |
| 937872 | N/A | N/A | 74138 | 74157 | TAACCTCTTCTTATCCCAAA | 97 | 2890 |
| 937884 | N/A | N/A | 76189 | 76208 | GAAACATTTATTGAACATAA | 78 | 2891 |
| 937896 | N/A | N/A | 82245 | 82264 | GCTTTTCATCAGGTGATAAA | 70 | 2892 |
| 937908 | N/A | N/A | 82847 | 82866 | GCTCCAATATCGGCAATGCT | 59 | 2893 |
| 937920 | N/A | N/A | 82922 | 82941 | TTTTTGTCCTTCACTTTCTC | 53 | 2894 |
| 937932 | N/A | N/A | 83774 | 83793 | AATTTTCCATATAAATTATG | 145 | 2895 |
| 937944 | N/A | N/A | 83853 | 83872 | CCTTTCTTGAAGTAAGCATA | 29 | 2896 |
| 937956 | N/A | N/A | 84392 | 84411 | CAGCCCCCTTCAGGTTTTTT | 59 | 2897 |
| 937968 | N/A | N/A | 84609 | 84628 | TTCTAAATAATTTATACAGT | 81 | 2898 |
| 937980 | N/A | N/A | 84762 | 84781 | CTCAGTTTGGAATCTTATTA | 35 | 2899 |

TABLE 39-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 937992 | N/A | N/A | 84820 | 84839 | AATGCTGGTTCCTTACAATT | 31 | 2900 |
| 938004 | N/A | N/A | 85059 | 85078 | CCCAAAGGGTTAATTAGGAT | 7 | 2901 |
| 938016 | N/A | N/A | 85188 | 85207 | TCTTGTACATTTTAACCCTT | 29 | 2902 |
| 938028 | N/A | N/A | 95368 | 95387 | TTAAAATCAACTGAGAAGAC | 95 | 2903 |
| 938040 | N/A | N/A | 97618 | 97637 | ACTTTTTATGTTGCTCCTTC | 28 | 2904 |
| 938052 | N/A | N/A | 98348 | 98367 | CTTAAACACCAGATGGTCAG | 74 | 2905 |
| 938064 | N/A | N/A | 100037 | 100056 | ATAGCTAAAGAGTCAAGTGG | 65 | 2906 |
| 938076 | N/A | N/A | 106796 | 106815 | AGAGGAAGTAAAAAAGAAGG | 91 | 2907 |
| 938088 | N/A | N/A | 110913 | 110932 | AACTGCCCCTCCAACACCCC | 84 | 2908 |
| 938100 | N/A | N/A | 117931 | 117950 | AGCACAGAATACTAGTTTAT | 55 | 2909 |
| 938112 | N/A | N/A | 119030 | 119049 | AAAAGTTCCCATTGCATTGT | 45 | 2910 |
| 938124 | N/A | N/A | 123159 | 123178 | TGATGAGGTGCTCCTGGATC | 60 | 2911 |
| 938136 | N/A | N/A | 125751 | 125770 | ATCAGTTTGTATGACCATAA | 9 | 2912 |
| 938148 | N/A | N/A | 129786 | 129805 | ACTTATTACCTTCCTGTATA | 69 | 2913 |
| 938160 | N/A | N/A | 130548 | 130567 | GGCACTGCATTCATTTTGAG | 64 | 2914 |
| 938172 | N/A | N/A | 132164 | 132183 | TTTGCTTATTATTCTCACAT | 12 | 2915 |
| 938184 | N/A | N/A | 132520 | 132539 | GTAGTTACATGTAACCATAA | 27 | 2916 |
| 938196 | N/A | N/A | 133494 | 133513 | ATTGTTAAAATATATACAAG | 100 | 2917 |
| 938208 | N/A | N/A | 134957 | 134976 | GCAGTCATTAGTGGTCCTAT | 21 | 2918 |
| 938220 | N/A | N/A | 137464 | 137483 | ATAAATTTCATCTTATCAGA | 97 | 2919 |
| 938232 | N/A | N/A | 139267 | 139286 | AATTTGTAACTAGGTTTTGT | 79 | 2920 |
| 938244 | N/A | N/A | 140114 | 140133 | TATACTTTAAATCAATACTA | 81 | 2921 |
| 938256 | N/A | N/A | 143759 | 143778 | CTTCTGCCACTCAGTTTACT | 87 | 2922 |
| 938268 | N/A | N/A | 146518 | 146537 | GGAAATGGAATTCATTGTGG | 33 | 2923 |
| 938280 | N/A | N/A | 147490 | 147509 | ATTAGACACTGGATCCAAGG | 53 | 2924 |

TABLE 40

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 20 | 32 |
| 937370 | 2356 | 2375 | 91240 | 91259 | CTGTTCGATGCAGGACTAGC | 49 | 2925 |
| 937382 | 4393 | 4412 | 149144 | 149163 | TTCATGACTTTCAAGGGTTA | 27 | 2926 |
| 937393 | 4413 | 4432 | 149164 | 149183 | TTCTTTTGCTAGCTGATGTG | 31 | 2927 |

TABLE 40-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 937417 | N/A | N/A | 4091 | 4110 | TCCTTCTCCCTTTGAACACT | 23 | 2928 |
| 937429 | N/A | N/A | 4534 | 4553 | GGCTAAGTAGTGTTTGGGAT | 4 | 2929 |
| 937441 | N/A | N/A | 4754 | 4773 | GTCAATGCAACTTAATAACC | 18 | 2930 |
| 937453 | N/A | N/A | 6585 | 6604 | TCCTTTAAAAATTCCCCACA | 73 | 2931 |
| 937465 | N/A | N/A | 8764 | 8783 | AATAGGGTTTTGTTCATGCT | 4 | 2932 |
| 937477 | N/A | N/A | 10345 | 10364 | TGATCTTGTGTATATATTAC | 11 | 2933 |
| 937489 | N/A | N/A | 11272 | 11291 | GACTGTATTCCATAAAACAA | 48 | 2934 |
| 937501 | N/A | N/A | 16482 | 16501 | CTATAAAACAGTAATGCCCT | 91 | 2935 |
| 937513 | N/A | N/A | 17163 | 17182 | TACATTTTGAATTACAATGC | 25 | 2936 |
| 937525 | N/A | N/A | 19925 | 19944 | ATTACGACCATTCTGCTCAG | 39 | 2937 |
| 937537 | N/A | N/A | 20254 | 20273 | CAAACCTCTTCACTCCTGCC | 66 | 2938 |
| 937549 | N/A | N/A | 23257 | 23276 | TTACGCTGTATTTTTACTCA | 23 | 2939 |
| 937561 | N/A | N/A | 26913 | 26932 | TTTCTTTTCCGTTTTTCATA | 21 | 2940 |
| 937573 | N/A | N/A | 28085 | 28104 | AGCAAAGACTTTGAAATCTC | 19 | 2941 |
| 937585 | N/A | N/A | 28587 | 28606 | TATAAACAAACTTTTTGATT | 104 | 2942 |
| 937597 | N/A | N/A | 28948 | 28967 | GGAATTATTCTCTCAACTAT | 89 | 2943 |
| 937609 | N/A | N/A | 32327 | 32346 | TATTCCATACAGATCGCATA | 52 | 2944 |
| 937621 | N/A | N/A | 32797 | 32816 | TTCTTGTTGTTGTTTACATT | 12 | 2945 |
| 937633 | N/A | N/A | 32810 | 32829 | TCCAATTTCAGACTTCTTGT | 10 | 2946 |
| 937645 | N/A | N/A | 33766 | 33785 | AATATACACAAACAATCTAA | 90 | 2947 |
| 937657 | N/A | N/A | 36312 | 36331 | GCTCTCTTTGCGCCTGTGTC | 20 | 2948 |
| 937669 | N/A | N/A | 36852 | 36871 | GAATCAGTATTTACTACTTC | 21 | 2949 |
| 937681 | N/A | N/A | 38517 | 38536 | GTCTACAAAATAACCTGTAA | 54 | 2950 |
| 937693 | N/A | N/A | 41719 | 41738 | AATGATGCTTTCAAAGGCAC | 90 | 2951 |
| 937705 | N/A | N/A | 45419 | 45438 | TTATAGCCAGGCATGTGGCA | 73 | 2952 |
| 937717 | N/A | N/A | 48165 | 48184 | TAAATTGTCATACTGTATTG | 55 | 2953 |
| 937729 | N/A | N/A | 49018 | 49037 | CTATGGTTTGTCTTAAGTAC | 46 | 2954 |
| 937741 | N/A | N/A | 49156 | 49175 | CTTTAGCTCATCAAGGTACC | 67 | 2955 |
| 937753 | N/A | N/A | 50759 | 50778 | ATAAAAACAGCTTTTGGTAT | 75 | 2956 |
| 937765 | N/A | N/A | 52610 | 52629 | AAGGCCACAGAACAGAGCCA | 110 | 2957 |
| 937777 | N/A | N/A | 55507 | 55526 | TGGTCATGAATAAGAATCGC | 77 | 2958 |
| 937789 | N/A | N/A | 57467 | 57486 | GTTTCACTAGGTTCTCAAAA | 32 | 2959 |
| 937801 | N/A | N/A | 58477 | 58496 | CCAGAATGAACACATATCTG | 95 | 2960 |
| 937813 | N/A | N/A | 60510 | 60529 | TTTGTTTAATCACAGTTTTC | 60 | 2961 |
| 937825 | N/A | N/A | 63655 | 63674 | AGGAGGCTAAGGTGAATCAC | 66 | 2962 |
| 937837 | N/A | N/A | 68850 | 68869 | AAATAGGTGAGGGACTGGAA | 80 | 2963 |

TABLE 40-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 937849 | N/A | N/A | 69112 | 69131 | AATTAACTGAGTTCTATAGG | 85 | 2964 |
| 937861 | N/A | N/A | 72541 | 72560 | ACTATGCCCAGCAAGTCTGG | 118 | 2965 |
| 937873 | N/A | N/A | 74238 | 74257 | CTTCTATAACTGTCATTGTC | 66 | 2966 |
| 937885 | N/A | N/A | 76310 | 76329 | GAAAGTTTATATAATCTGGC | 96 | 2967 |
| 937897 | N/A | N/A | 82325 | 82344 | AGATCCTGTGTTCCAGACAC | 39 | 2968 |
| 937909 | N/A | N/A | 82848 | 82867 | GGCTCCAATATCGGCAATGC | 34 | 2969 |
| 937921 | N/A | N/A | 82952 | 82971 | TCCATCAATCTTGGTCTATC | 26 | 2970 |
| 937933 | N/A | N/A | 83784 | 83803 | CATAGGTTAGAATTTTCCAT | 14 | 2971 |
| 937945 | N/A | N/A | 83883 | 83902 | TCATGTCTTGTATTATAAGT | 57 | 2972 |
| 937957 | N/A | N/A | 84402 | 84421 | ATATATTTCTCAGCCCCCTT | 61 | 2973 |
| 937969 | N/A | N/A | 84673 | 84692 | GATAATATTCATTGCTATTT | 23 | 2974 |
| 937981 | N/A | N/A | 84763 | 84782 | ACTCAGTTTGGAATCTTATT | 34 | 2975 |
| 937993 | N/A | N/A | 84821 | 84840 | AAATGCTGGTTCCTTACAAT | 50 | 2976 |
| 938005 | N/A | N/A | 85101 | 85120 | TTAACCTCCTTAAGATTAAG | 89 | 2977 |
| 938017 | N/A | N/A | 85189 | 85208 | TTCTTGTACATTTTAACCCT | 27 | 2978 |
| 938029 | N/A | N/A | 95475 | 95494 | TAACGGTTGCTTAGGGTTGG | 36 | 2979 |
| 938041 | N/A | N/A | 97619 | 97638 | GACTTTTTATGTTGCTCCTT | 15 | 2980 |
| 938053 | N/A | N/A | 98485 | 98504 | AAATGAAGGACTACAGATAT | 89 | 2981 |
| 938065 | N/A | N/A | 100065 | 100084 | GCATCGCAAGCTTTACTGCA | 74 | 2982 |
| 938077 | N/A | N/A | 106803 | 106822 | GGAGCGAAGAGGAAGTAAAA | 138 | 2983 |
| 938089 | N/A | N/A | 111200 | 111219 | GTCATTAAGTAGGTGAATTC | 70 | 2984 |
| 938101 | N/A | N/A | 118324 | 118343 | TGAGAAATGTCTTTTCTGTA | 36 | 2985 |
| 938113 | N/A | N/A | 119031 | 119050 | AAAAAGTTCCCATTGCATTG | 46 | 2986 |
| 938125 | N/A | N/A | 123631 | 123650 | AAACTGTTGGCTCAAATGAT | 79 | 2987 |
| 938137 | N/A | N/A | 125847 | 125866 | AAGGTAGTCCTATTAGATTA | 53 | 2988 |
| 938149 | N/A | N/A | 129787 | 129806 | TACTTATTACCTTCCTGTAT | 72 | 2989 |
| 938161 | N/A | N/A | 130731 | 130750 | CTCAGCCTCAAACACCAGTT | 66 | 2990 |
| 938173 | N/A | N/A | 132165 | 132184 | TTTTGCTTATTATTCTCACA | 11 | 2991 |
| 938185 | N/A | N/A | 132521 | 132540 | TGTAGTTACATGTAACCATA | 25 | 2992 |
| 938197 | N/A | N/A | 133701 | 133720 | GTCTCAAAAGCATGCATACA | 36 | 2993 |
| 938209 | N/A | N/A | 135061 | 135080 | GAATAAAATAATTATCCTAT | 110 | 2994 |
| 938221 | N/A | N/A | 137468 | 137487 | AGGCATAAATTTCATCTTAT | 8 | 2995 |
| 938233 | N/A | N/A | 139268 | 139287 | TAATTTGTAACTAGGTTTTG | 89 | 2996 |
| 938245 | N/A | N/A | 140734 | 140753 | GCTGAGTGAATGTACATAGG | 21 | 2997 |

TABLE 40-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 938257 | N/A | N/A | 143795 | 143814 | AAGGACCACAGTCTCTCTCA | 73 | 2998 |
| 938269 | N/A | N/A | 146633 | 146652 | AACTTCCCAGAGCTGTGGAA | 79 | 2999 |
| 938281 | N/A | N/A | 147720 | 147739 | GGACTCTCAGGAAAGGGCAA | 62 | 3000 |

TABLE 41

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 22 | 32 |
| 937364 | 1078 | 1097 | 49252 | 49271 | CTTTTCTCATGTGCGGCATC | 26 | 3001 |
| 937374 | 2459 | 2478 | 91729 | 91748 | TGATGTTTCATTGGGTTTAA | 13 | 3002 |
| 937386 | 4398 | 4417 | 149149 | 149168 | ATGTGTTCATGACTTTCAAG | 18 | 3003 |
| 937397 | 4418 | 4437 | 149169 | 149188 | GTTACTTCTTTTGCTAGCTG | 16 | 3004 |
| 937409 | N/A | N/A | 3346 | 3365 | CTAACTTCTCCCCTCCAGAG | 69 | 3005 |
| 937421 | N/A | N/A | 4525 | 4544 | GTGTTTGGGATGCTTCAGAC | 8 | 3006 |
| 937433 | N/A | N/A | 4745 | 4764 | ACTTAATAACCTTAGTTTTA | 83 | 3007 |
| 937445 | N/A | N/A | 5173 | 5192 | GAATGCTGCATTTTTTTTCA | 42 | 3008 |
| 937457 | N/A | N/A | 7141 | 7160 | TAAGTTGCAATGCCTCAAGA | 44 | 3009 |
| 937469 | N/A | N/A | 9929 | 9948 | TAGAGTTTTTGCCTTCCATT | 5 | 3010 |
| 937481 | N/A | N/A | 10349 | 10368 | AGCATGATCTTGTGTATATA | 5 | 3011 |
| 937493 | N/A | N/A | 13758 | 13777 | GGCACGAAACTGACATTTTC | 20 | 3012 |
| 937505 | N/A | N/A | 17154 | 17173 | AATTACAATGCGGTATATAT | 29 | 3013 |
| 937517 | N/A | N/A | 18681 | 18700 | CAGTATCTCAGTTTTTTTTT | 22 | 3014 |
| 937529 | N/A | N/A | 19931 | 19950 | CGCATCATTACGACCATTCT | 26 | 3015 |
| 937541 | N/A | N/A | 22994 | 23013 | AACATAGTTTCTCATCACCA | 26 | 3016 |
| 937553 | N/A | N/A | 24547 | 24566 | CTGGCCACGACAAGTTAATT | 88 | 3017 |
| 937565 | N/A | N/A | 28032 | 28051 | ATCTCTTTGACCTAAAGGCA | 49 | 3018 |
| 937577 | N/A | N/A | 28491 | 28510 | GATTGTTTTCTTCATTATTG | 23 | 3019 |
| 937589 | N/A | N/A | 28886 | 28905 | CTTGTTCAGTGTCCTTCTAG | 25 | 3020 |
| 937601 | N/A | N/A | 30392 | 30411 | GGGATTAGGATGCCAAATAG | 18 | 3021 |
| 937613 | N/A | N/A | 32332 | 32351 | AGTAATATTCCATACAGATC | 32 | 3022 |
| 937625 | N/A | N/A | 32801 | 32820 | AGACTTCTTGTTGTTGTTTA | 28 | 3023 |
| 937637 | N/A | N/A | 32814 | 32833 | TTCTTCCAATTTCAGACTTC | 34 | 3024 |
| 937649 | N/A | N/A | 34713 | 34732 | ACCAGGAAATTGCTTCTAAT | 55 | 3025 |

TABLE 41-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 937661 | N/A | N/A | 36317 | 36336 | CATGTGCTCTCTTTGCGCCT | 60 | 3026 |
| 937673 | N/A | N/A | 37129 | 37148 | ATATGGCCCTAGAGCCTAAA | 105 | 3027 |
| 937685 | N/A | N/A | 41273 | 41292 | AGGGACTAGAGCATCCATAA | 41 | 3028 |
| 937697 | N/A | N/A | 43295 | 43314 | AACAAAGGCCAAGAGCATAT | 49 | 3029 |
| 937709 | N/A | N/A | 47548 | 47567 | ATGGAATTACTTTATTCTAC | 64 | 3030 |
| 937721 | N/A | N/A | 48532 | 48551 | CAAAACATTAACAATACACT | 89 | 3031 |
| 937733 | N/A | N/A | 49147 | 49166 | ATCAAGGTACCAGTTCTTAT | 21 | 3032 |
| 937745 | N/A | N/A | 49228 | 49247 | ACCAAATCACACTAAAATGA | 99 | 3033 |
| 937757 | N/A | N/A | 51198 | 51217 | AGTAGGGAACCTTTTTTTTT | 45 | 3034 |
| 937769 | N/A | N/A | 53410 | 53429 | ACAACAAACCAAACCACATA | 82 | 3035 |
| 937781 | N/A | N/A | 56404 | 56423 | CTAGAAAGGCAGATGTTGAA | 98 | 3036 |
| 937793 | N/A | N/A | 57473 | 57492 | TACACAGTTTCACTAGGTTC | 33 | 3037 |
| 937805 | N/A | N/A | 58745 | 58764 | TGAAGTTATTGTTCTGACTT | 42 | 3038 |
| 937817 | N/A | N/A | 61186 | 61205 | TTTCTCACATTTACCATTCA | 84 | 3039 |
| 937829 | N/A | N/A | 66835 | 66854 | AAAAAACTGACCTATTCTAT | 87 | 3040 |
| 937841 | N/A | N/A | 69103 | 69122 | AGTTCTATAGGTGCTTAAGT | 32 | 3041 |
| 937853 | N/A | N/A | 70105 | 70124 | GAATACTCATCTGTTCTAAC | 74 | 3042 |
| 937865 | N/A | N/A | 73527 | 73546 | TGAAAAGCACACATTTAAGT | 78 | 3043 |
| 937877 | N/A | N/A | 74702 | 74721 | GTCTCAGAAAGTTCAGGTAG | 76 | 3044 |
| 937889 | N/A | N/A | 81890 | 81909 | TCTACTTGCATTCTCTACCT | 70 | 3045 |
| 937901 | N/A | N/A | 82428 | 82447 | TATTCACCCCATCTCCTTCC | 78 | 3046 |
| 937913 | N/A | N/A | 82853 | 82872 | TTCATGGCTCCAATATCGGC | 36 | 3047 |
| 937925 | N/A | N/A | 83229 | 83248 | TTATTTTCCCTGAAAATGAG | 109 | 3048 |
| 937937 | N/A | N/A | 83788 | 83807 | TGCACATAGGTTAGAATTTT | 14 | 3049 |
| 937949 | N/A | N/A | 84132 | 84151 | TATTGCTATTACTATTTCCA | 49 | 3050 |
| 937961 | N/A | N/A | 84406 | 84425 | TATCATATATTTCTCAGCCC | 31 | 3051 |
| 937973 | N/A | N/A | 84754 | 84773 | GGAATCTTATTAAGCAAGTC | 4 | 3052 |
| 937985 | N/A | N/A | 84811 | 84830 | TCCTTACAATTATCTATGAT | 57 | 3053 |
| 937997 | N/A | N/A | 85049 | 85068 | TAATTAGGATCTATACACAC | 70 | 3054 |
| 938009 | N/A | N/A | 85180 | 85199 | ATTTTAACCCTTTGAGGACA | 88 | 3055 |
| 938021 | N/A | N/A | 92134 | 92153 | TAAAACTCAAATTCATCAGT | 95 | 3056 |
| 938033 | N/A | N/A | 96191 | 96210 | GGACTTGTACACACAATATA | 74 | 3057 |
| 938045 | N/A | N/A | 97624 | 97643 | GATAAGACTTTTTATGTTGC | 13 | 3058 |
| 938057 | N/A | N/A | 98776 | 98795 | TAAACACTTTATAGGCAATA | 69 | 3059 |
| 938069 | N/A | N/A | 102537 | 102556 | TTAAACTCCCAGGGACATTA | 85 | 3060 |
| 938081 | N/A | N/A | 108797 | 108816 | ATTCCCAAGTGATAAGAGAT | 94 | 3061 |

TABLE 41-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 938093 | N/A | N/A | 112501 | 112520 | CTATAGAAAAGCAACCTAT | 115 | 3062 |
| 938105 | N/A | N/A | 118988 | 119007 | CTACACCTGCTGGTGATACA | 79 | 3063 |
| 938117 | N/A | N/A | 120010 | 120029 | AATCTAAGGCCACATGAAAA | 86 | 3064 |
| 938129 | N/A | N/A | 124704 | 124723 | AGTAACAGCAATAAAGAGAG | 78 | 3065 |
| 938141 | N/A | N/A | 127842 | 127861 | ACTATCAGTTTACAAAGATT | 75 | 3066 |
| 938153 | N/A | N/A | 129792 | 129811 | TTTGTTACTTATTACCTTCC | 57 | 3067 |
| 938165 | N/A | N/A | 131803 | 131822 | TCCACAAAGATGCTTTGCCA | 93 | 3068 |
| 938177 | N/A | N/A | 132217 | 132236 | TAAGTTGATCTACACAAATT | 88 | 3069 |
| 938189 | N/A | N/A | 132526 | 132545 | GCCCATGTAGTTACATGTAA | 46 | 3070 |
| 938201 | N/A | N/A | 134052 | 134071 | GTAGTTCAGATTTGGCTGAG | 22 | 3071 |
| 938213 | N/A | N/A | 136574 | 136593 | AAAAACATTACTAATGGAAA | 100 | 3072 |
| 938225 | N/A | N/A | 138397 | 138416 | TAGTACTCCTTCCTATTTAA | 49 | 3073 |
| 938237 | N/A | N/A | 139273 | 139292 | GTGTTTAATTTGTAACTAGG | 9 | 3074 |
| 938249 | N/A | N/A | 142569 | 142588 | ATACACTGGGAAAATTTTCC | 56 | 3075 |
| 938261 | N/A | N/A | 145704 | 145723 | CTAGCTGGGAGAGCCTCTAG | 81 | 3076 |
| 938273 | N/A | N/A | 146798 | 146817 | AGCCTCTGGTAGACACCTAC | 52 | 3077 |

TABLE 42

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 10 | 32 |
| 708202 | 1481 | 1500 | 81641 | 81660 | TTCTGCTAACTGGTTTGCCC | 36 | 3078 |
| 937376 | 3484 | 3503 | 136957 | 136976 | TTGTTGTATGGTAATTTGGG | 16 | 3079 |
| 937388 | 4400 | 4419 | 149151 | 149170 | TGATGTGTTCATGACTTTCA | 17 | 3080 |
| 937399 | 4420 | 4439 | 149171 | 149190 | TTGTTACTTCTTTTGCTAGC | 83 | 3081 |
| 937411 | N/A | N/A | 3769 | 3788 | ATCTCCAGGGTCCAGCCTGG | 85 | 3082 |
| 937423 | N/A | N/A | 4527 | 4546 | TAGTGTTTGGGATGCTTCAG | 8 | 3083 |
| 937435 | N/A | N/A | 4747 | 4766 | CAACTTAATAACCTTAGTTT | 62 | 3084 |
| 937447 | N/A | N/A | 5308 | 5327 | AATAAATCACTTCTGAAAGT | 95 | 3085 |
| 937459 | N/A | N/A | 7503 | 7522 | GTAAACTCCAAAAGGACAAT | 39 | 3086 |
| 937471 | N/A | N/A | 9931 | 9950 | CTTAGAGTTTTGCCTTCCA | 2 | 3087 |
| 937483 | N/A | N/A | 10352 | 10371 | CACAGCATGATCTTGTGTAT | 102 | 3088 |
| 937495 | N/A | N/A | 13900 | 13919 | AGTTCTGATACAGTTAATAA | 40 | 3089 |
| 937507 | N/A | N/A | 17156 | 17175 | TGAATTACAATGCGGTATAT | 16 | 3090 |

TABLE 42-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 937519 | N/A | N/A | 18683 | 18702 | GCCAGTATCTCAGTTTTTTT | 30 | 3091 |
| 937531 | N/A | N/A | 19933 | 19952 | TGCGCATCATTACGACCATT | 64 | 3092 |
| 937543 | N/A | N/A | 23250 | 23269 | GTATTTTTACTCACCTTTTC | 43 | 3093 |
| 937555 | N/A | N/A | 25504 | 25523 | AAACCAAACCAATAGTCTGG | 59 | 3094 |
| 937567 | N/A | N/A | 28078 | 28097 | ACTTTGAAATCTCACAAGGT | 73 | 3095 |
| 937579 | N/A | N/A | 28493 | 28512 | CGGATTGTTTTCTTCATTAT | 6 | 3096 |
| 937591 | N/A | N/A | 28888 | 28907 | GTCTTGTTCAGTGTCCTTCT | 4 | 3097 |
| 937603 | N/A | N/A | 30585 | 30604 | AATCCTCTTCCATCCCCTTT | 34 | 3098 |
| 937615 | N/A | N/A | 32334 | 32353 | TAAGTAATATTCCATACAGA | 52 | 3099 |
| 937627 | N/A | N/A | 32804 | 32823 | TTCAGACTTCTTGTTGTTGT | 16 | 3100 |
| 937639 | N/A | N/A | 32816 | 32835 | TGTTCTTCCAATTTCAGACT | 8 | 3101 |
| 937651 | N/A | N/A | 36032 | 36051 | GTTATGACTACTCCACGAAC | 36 | 3102 |
| 937663 | N/A | N/A | 36845 | 36864 | TATTTACTACTTCTGCATGG | 31 | 3103 |
| 937675 | N/A | N/A | 37484 | 37503 | ACTTGGTCAGGAACTCTTGG | 53 | 3104 |
| 937687 | N/A | N/A | 41275 | 41294 | TGAGGGACTAGAGCATCCAT | 46 | 3105 |
| 937699 | N/A | N/A | 43449 | 43468 | CATATCGAAGCAGTATTCTC | 35 | 3106 |
| 937711 | N/A | N/A | 47653 | 47672 | ATTAGACTGGATAAAAGGAG | 46 | 3107 |
| 937723 | N/A | N/A | 48598 | 48617 | ACTTTTTATACCTCATCAGG | 42 | 3108 |
| 937735 | N/A | N/A | 49149 | 49168 | TCATCAAGGTACCAGTTCTT | 31 | 3109 |
| 937747 | N/A | N/A | 49954 | 49973 | ATCAGTAGCATTCTTGACCA | 37 | 3110 |
| 937759 | N/A | N/A | 51425 | 51444 | GTATTTTCTTGCCTTTCTAT | 18 | 3111 |
| 937771 | N/A | N/A | 54713 | 54732 | GTTTCTCAGTAAATCAAACT | 78 | 3112 |
| 937783 | N/A | N/A | 56926 | 56945 | ATACAGAAGAGGAAATTCTG | 112 | 3113 |
| 937795 | N/A | N/A | 57475 | 57494 | GGTACACAGTTTCACTAGGT | 4 | 3114 |
| 937807 | N/A | N/A | 59465 | 59484 | TCTCCTTCAGCTGTGTCTTC | 34 | 3115 |
| 937819 | N/A | N/A | 61340 | 61359 | CAGTCTTACTGAAAATGTCC | 83 | 3116 |
| 937831 | N/A | N/A | 67200 | 67219 | ATATATATGTTGAACACCTG | 70 | 3117 |
| 937843 | N/A | N/A | 69105 | 69124 | TGAGTTCTATAGGTGCTTAA | 54 | 3118 |
| 937855 | N/A | N/A | 71732 | 71751 | TAACATCACAAACCCTCAAA | 73 | 3119 |
| 937867 | N/A | N/A | 73814 | 73833 | TTTGATACTAACCTGAATCA | 102 | 3120 |
| 937879 | N/A | N/A | 74908 | 74927 | AGATATACCTTCGGAGTACT | 50 | 3121 |
| 937891 | N/A | N/A | 82029 | 82048 | AGATAACTATTTTAACAAGC | 50 | 3122 |
| 937903 | N/A | N/A | 82476 | 82495 | GCACTAACTGTTCTCTGTGT | 51 | 3123 |
| 937915 | N/A | N/A | 82855 | 82874 | TTTTCATGGCTCCAATATCG | 33 | 3124 |
| 937927 | N/A | N/A | 83445 | 83464 | AAACTATTTTATCAATGATA | 108 | 3125 |
| 937939 | N/A | N/A | 83791 | 83810 | TGTTGCACATAGGTTAGAAT | 5 | 3126 |

TABLE 42-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 937951 | N/A | N/A | 84180 | 84199 | TAGCTAAAATTGAATGTCCA | 40 | 3127 |
| 937963 | N/A | N/A | 84410 | 84429 | TAAGTATCATATATTTCTCA | 41 | 3128 |
| 937975 | N/A | N/A | 84756 | 84775 | TTGGAATCTTATTAAGCAAG | 15 | 3129 |
| 937987 | N/A | N/A | 84813 | 84832 | GTTCCTTACAATTATCTATG | 8 | 3130 |
| 937999 | N/A | N/A | 85051 | 85070 | GTTAATTAGGATCTATACAC | 40 | 3131 |
| 938011 | N/A | N/A | 85182 | 85201 | ACATTTTAACCCTTTGAGGA | 49 | 3132 |
| 938023 | N/A | N/A | 92248 | 92267 | TAGGCAAAGACCACTTTAAA | 64 | 3133 |
| 938035 | N/A | N/A | 96398 | 96417 | ATGTAATTCTTAAAAAACC | 86 | 3134 |
| 938047 | N/A | N/A | 97626 | 97645 | GAGATAAGACTTTTTATGTT | 27 | 3135 |
| 938059 | N/A | N/A | 99449 | 99468 | GTTCTAAACTATTTATAGAC | 98 | 3136 |
| 938071 | N/A | N/A | 104201 | 104220 | TGAAGAACATTATGCAAAAA | 77 | 3137 |
| 938083 | N/A | N/A | 109630 | 109649 | ACTGACTAAAGCACCCTTGG | 76 | 3138 |
| 938095 | N/A | N/A | 116416 | 116435 | ACTACAAGCAAACACAGGCA | 72 | 3139 |
| 938107 | N/A | N/A | 119024 | 119043 | TCCCATTGCATTGTTTTAAG | 16 | 3140 |
| 938119 | N/A | N/A | 120188 | 120207 | AATGACACTTCATAACCACT | 34 | 3141 |
| 938131 | N/A | N/A | 124921 | 124940 | GGTGAAACTTAAGACTTAAA | 16 | 3142 |
| 938143 | N/A | N/A | 128091 | 128110 | TACAACCCCTAAGGAAATAA | 57 | 3143 |
| 938155 | N/A | N/A | 129794 | 129813 | ACTTTGTTACTTATTACCTT | 23 | 3144 |
| 938167 | N/A | N/A | 132158 | 132177 | TATTATTCTCACATATAAAT | 84 | 3145 |
| 938179 | N/A | N/A | 132402 | 132421 | ACTACGGTAGTTCTCAGAAA | 38 | 3146 |
| 938191 | N/A | N/A | 132648 | 132667 | TATAAATTCTTAAATAACTC | 97 | 3147 |
| 938203 | N/A | N/A | 134199 | 134218 | CCAGCTCCTAGTGTCCTTTT | 52 | 3148 |
| 938215 | N/A | N/A | 136866 | 136885 | GGTTGACATATTAGTAATTT | 27 | 3149 |
| 938227 | N/A | N/A | 138522 | 138541 | CACCCCAAAATAACTCAAAA | 71 | 3150 |
| 938239 | N/A | N/A | 139275 | 139294 | GTGTGTTTAATTTGTAACTA | 14 | 3151 |
| 938251 | N/A | N/A | 142950 | 142969 | GCAAACACAGACATATGCAG | 65 | 3152 |
| 938263 | N/A | N/A | 145980 | 145999 | TTCCAAGGTAAGTGTGTAGG | 41 | 3153 |
| 938275 | N/A | N/A | 146860 | 146879 | AACAGAGTGAGGTTTTAGGG | 20 | 3154 |

TABLE 43

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 708199 | 1477 | 1496 | 81637 | 81656 | GCTAACTGGTTTGCCCTTGC | 17 | 32 |
| 937365 | 1560 | 1579 | 81720 | 81739 | CTGTGTATTTTCTTCCTCA | 6 | 3155 |
| 937377 | 3490 | 3509 | 136963 | 136982 | GTCTCCTTGTTGTATGGTAA | 21 | 3156 |
| 937389 | 4401 | 4420 | 149152 | 149171 | CTGATGTGTTCATGACTTTC | 15 | 3157 |
| 937400 | 4421 | 4440 | 149172 | 149191 | CTTGTTACTTCTTTTGCTAG | 30 | 3158 |
| 937412 | N/A | N/A | 3802 | 3821 | GCCCGCCCCTGCCACCAGC | 60 | 3159 |
| 937424 | N/A | N/A | 4528 | 4547 | GTAGTGTTTGGGATGCTTCA | 8 | 3160 |
| 937436 | N/A | N/A | 4748 | 4767 | GCAACTTAATAACCTTAGTT | 7 | 3161 |
| 937448 | N/A | N/A | 5951 | 5970 | CTACAAAATAACATACACAA | 77 | 3162 |
| 937460 | N/A | N/A | 7520 | 7539 | CCTAGTCACATTAGAATGTA | 95 | 3163 |
| 937472 | N/A | N/A | 9933 | 9952 | AGCTTAGAGTTTTTGCCTTC | 15 | 3164 |
| 937484 | N/A | N/A | 10353 | 10372 | ACACAGCATGATCTTGTGTA | 94 | 3165 |
| 937496 | N/A | N/A | 14454 | 14473 | CACAAAGTCCACAGCAAATG | 51 | 3166 |
| 937508 | N/A | N/A | 17157 | 17176 | TTGAATTACAATGCGGTATA | 9 | 3167 |
| 937520 | N/A | N/A | 18684 | 18703 | GGCCAGTATCTCAGTTTTTT | 91 | 3168 |
| 937532 | N/A | N/A | 19934 | 19953 | GTGCGCATCATTACGACCAT | 49 | 3169 |
| 937544 | N/A | N/A | 23251 | 23270 | TGTATTTTACTCACCTTTT | 35 | 3170 |
| 937556 | N/A | N/A | 26045 | 26064 | CTAGTCTATACTACCACATA | 81 | 3171 |
| 937568 | N/A | N/A | 28079 | 28098 | GACTTTGAAATCTCACAAGG | 29 | 3172 |
| 937580 | N/A | N/A | 28495 | 28514 | ACCGGATTGTTTTCTTCATT | 15 | 3173 |
| 937592 | N/A | N/A | 28890 | 28909 | AAGTCTTGTTCAGTGTCCTT | 10 | 3174 |
| 937604 | N/A | N/A | 31032 | 31051 | TCCTCCTCTCTTCATGGCCT | 85 | 3175 |
| 937616 | N/A | N/A | 32403 | 32422 | GAAATGAAGATGAAAATAGT | 88 | 3176 |
| 937628 | N/A | N/A | 32805 | 32824 | TTTCAGACTTCTTGTTGTTG | 20 | 3177 |
| 937640 | N/A | N/A | 32818 | 32837 | TTTGTTCTTCCAATTTCAGA | 35 | 3178 |
| 937652 | N/A | N/A | 36188 | 36207 | AGAAAAGATTGTATTTTACA | 70 | 3179 |
| 937664 | N/A | N/A | 36846 | 36865 | GTATTTACTACTTCTGCATG | 30 | 3180 |
| 937676 | N/A | N/A | 37600 | 37619 | GGTCGGCAAGCAGTGTCTTT | 37 | 3181 |
| 937688 | N/A | N/A | 41278 | 41297 | TTATGAGGGACTAGAGCATC | 41 | 3182 |
| 937700 | N/A | N/A | 43838 | 43857 | GTGTACTTATAGTCTGTACA | 70 | 3183 |
| 937712 | N/A | N/A | 47673 | 47692 | GTACTTTTACAATGAATTAT | 44 | 3184 |
| 937724 | N/A | N/A | 48749 | 48768 | AAATTACCTTCGGACTGTAA | 76 | 3185 |
| 937736 | N/A | N/A | 49150 | 49169 | CTCATCAAGGTACCAGTTCT | 30 | 3186 |
| 937748 | N/A | N/A | 49980 | 49999 | GGACAAGAAATTTTCAGTTG | 11 | 3187 |
| 937760 | N/A | N/A | 51971 | 51990 | ACCTGATGTCCTAAACACAT | 65 | 3188 |
| 937772 | N/A | N/A | 54912 | 54931 | AGATACACGAATACAGAGCC | 77 | 3189 |

TABLE 43-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 937784 | N/A | N/A | 57158 | 57177 | AGAGCTCAAACTGTAACAGG | 51 | 3190 |
| 937796 | N/A | N/A | 57987 | 58006 | ATGCAGTACAACATTCCATT | 10 | 3191 |
| 937808 | N/A | N/A | 59479 | 59498 | AATCTACTTTTATGTCTCCT | 20 | 3192 |
| 937820 | N/A | N/A | 61420 | 61439 | AAACCATCCAAGACAAGAGA | 51 | 3193 |
| 937832 | N/A | N/A | 67596 | 67615 | TCTAGTGAGTATAAAAATAT | 55 | 3194 |
| 937844 | N/A | N/A | 69106 | 69125 | CTGAGTTCTATAGGTGCTTA | 69 | 3195 |
| 937856 | N/A | N/A | 71745 | 71764 | TTAACATCAGATTTAACATC | 66 | 3196 |
| 937868 | N/A | N/A | 73832 | 73851 | ACTAGAAATCTGACCTTATT | 71 | 3197 |
| 937880 | N/A | N/A | 75267 | 75286 | TATCAATCCATCAAAAATAT | 72 | 3198 |
| 937892 | N/A | N/A | 82113 | 82132 | TCTGTATGTTCCTAGTACTT | 42 | 3199 |
| 937904 | N/A | N/A | 82509 | 82528 | GTTACCAAATTCTCACAGTT | 27 | 3200 |
| 937916 | N/A | N/A | 82856 | 82875 | TTTTTCATGGCTCCAATATC | 58 | 3201 |
| 937928 | N/A | N/A | 83465 | 83484 | AAGTATTTTAAGTATTTAGA | 94 | 3202 |
| 937940 | N/A | N/A | 83792 | 83811 | GTGTTGCACATAGGTTAGAA | 7 | 3203 |
| 937952 | N/A | N/A | 84258 | 84277 | TGGAGAAAAGACTCAATGAA | 58 | 3204 |
| 937964 | N/A | N/A | 84411 | 84430 | TTAAGTATCATATATTTCTC | 62 | 3205 |
| 937976 | N/A | N/A | 84757 | 84776 | TTTGGAATCTTATTAAGCAA | 42 | 3206 |
| 937988 | N/A | N/A | 84814 | 84833 | GGTTCCTTACAATTATCTAT | 18 | 3207 |
| 938000 | N/A | N/A | 85052 | 85071 | GGTTAATTAGGATCTATACA | 19 | 3208 |
| 938012 | N/A | N/A | 85183 | 85202 | TACATTTTAACCCTTTGAGG | 43 | 3209 |
| 938024 | N/A | N/A | 92255 | 92274 | TAAAGGATAGGCAAAGACCA | 51 | 3210 |
| 938036 | N/A | N/A | 97572 | 97591 | AGGTTTACAGAAAGTTGTGC | 22 | 3211 |
| 938048 | N/A | N/A | 97726 | 97745 | TCCTGGTATGCCCCTATGGA | 58 | 3212 |
| 938060 | N/A | N/A | 99771 | 99790 | TTACTATGGGTTGGACACTT | 61 | 3213 |
| 938072 | N/A | N/A | 104211 | 104230 | CCAGTGTCTCTGAAGAACAT | 50 | 3214 |
| 938084 | N/A | N/A | 109930 | 109949 | CCCTTGTGCCTTGAATAAAA | 79 | 3215 |
| 938096 | N/A | N/A | 116591 | 116610 | TATAATCACAACTGATGGGC | 28 | 3216 |
| 938108 | N/A | N/A | 119025 | 119044 | TTCCCATTGCATTGTTTTAA | 25 | 3217 |
| 938120 | N/A | N/A | 122100 | 122119 | CAAACAAAAGGAATAAGCT | 76 | 3218 |
| 938132 | N/A | N/A | 125124 | 125143 | AAGGGCTGCCAGAAACAGTG | 44 | 3219 |
| 938144 | N/A | N/A | 128108 | 128127 | AAAGAATGTCACCATTTTAC | 44 | 3220 |
| 938156 | N/A | N/A | 129795 | 129814 | TACTTTGTTACTTATTACCT | 65 | 3221 |
| 938168 | N/A | N/A | 132159 | 132178 | TTATTATTCTCACATATAAA | 90 | 3222 |
| 938180 | N/A | N/A | 132466 | 132485 | TGAATAAACCAAAATTATCC | 71 | 3223 |
| 938192 | N/A | N/A | 133234 | 133253 | GATAATGTGGAAAATTAAGA | 75 | 3224 |
| 938204 | N/A | N/A | 134531 | 134550 | ATAGAACAAAACAATTCTTT | 90 | 3225 |

TABLE 43-continued

Percent control of human ATXN2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | ATXN2 % control | SEQ ID NO |
|---|---|---|---|---|---|---|---|
| 938216 | N/A | N/A | 136915 | 136934 | AAAGGTAAATTAGCCTTTTG | 88 | 3226 |
| 938228 | N/A | N/A | 138908 | 138927 | CCAAACTACTAACAGAGACA | 73 | 3227 |
| 938240 | N/A | N/A | 139341 | 139360 | TAACCACATTCCAGAACTAG | 81 | 3228 |
| 938252 | N/A | N/A | 143062 | 143081 | TATAGTTCCCAGCCCTCTCT | 63 | 3229 |
| 938264 | N/A | N/A | 146037 | 146056 | CCCCGGTAGTCACTTCGGAG | 86 | 3230 |
| 938276 | N/A | N/A | 146917 | 146936 | GGGCACATGGCAAATTTGAG | 32 | 3231 |

Example 4: Effect of 5-10-5 MOE Gapmers with Mixed Internucleoside Linkages on Human ATXN2 RNA Expression In Vitro, Multiple Doses Modified oligonucleotides selected from the examples above were tested at various doses in SCA2-04 cells. Cells were plated at a density of 20,000 cells per well and transfected using electroporation with 31.25 nM, 125.00 nM, 500.00 nM, and 2,000.00 nM concentrations of modified oligonucleotide, as specified in the tables below. After a treatment period of approximately 24 hours, total RNA was isolated from the cells and ATXN2 RNA levels were measured by quantitative real-time PCR. Human ATXN2 primer probe set hAtaxin_LTS01321 (described hereinabove in Example 1) was used to measure RNA levels. ATXN2 RNA levels were adjusted according to total RNA content, as measured by RIBOGREEN®. Results are presented in the tables below as percent ATXN2 RNA expression relative to untreated control cells. As illustrated in the tables below, ATXN2 RNA levels were reduced in a dose-dependent manner in modified oligonucleotide-treated cells. $IC_{50}$ was calculated using the "log(inhibitor) vs. response–variable slope (4 parameters)" formula using Prism6 software.

TABLE 44

Dose-dependent reduction of human ATXN2 RNA expression in SCA2-04 cells

| Compound Number | ATXN2 expression (% control) | | | | $IC_{50}$ (µM) |
|---|---|---|---|---|---|
| | 31.25 nM | 125.00 nM | 500.00 nM | 2,000.00 nM | |
| 708199 | 126 | 94 | 59 | 30 | 0.8 |
| 755233 | 119 | 113 | 93 | 41 | >2.0 |
| 756959 | 132 | 118 | 89 | 32 | 1.5 |
| 756960 | 106 | 103 | 90 | 36 | 2.0 |
| 756978 | 106 | 105 | 56 | 20 | 0.7 |
| 756980 | 128 | 126 | 83 | 35 | 2.0 |
| 756981 | 98 | 95 | 72 | 38 | 1.6 |
| 756985 | 98 | 517 | 84 | 33 | 1.5 |
| 756989 | 134 | 137 | 87 | 52 | >2.0 |
| 756991 | 117 | 204 | 77 | 37 | 1.4 |
| 756993 | 137 | 138 | 67 | 21 | 1.0 |
| 756996 | 128 | 104 | 81 | 33 | 1.3 |
| 756997 | 120 | 111 | 82 | 24 | 1.1 |
| 757000 | 122 | 114 | 86 | 32 | 1.5 |
| 757052 | 85 | 77 | 43 | 15 | 0.3 |
| 757055 | 92 | 86 | 58 | 27 | 0.7 |

TABLE 44-continued

Dose-dependent reduction of human ATXN2 RNA expression in SCA2-04 cells

| Compound Number | ATXN2 expression (% control) | | | | $IC_{50}$ (µM) |
|---|---|---|---|---|---|
| | 31.25 nM | 125.00 nM | 500.00 nM | 2,000.00 nM | |
| 757057 | 133 | 127 | 87 | 42 | 2.0 |
| 757066 | 91 | 81 | 59 | 19 | 0.5 |
| 757072 | 151 | 125 | 88 | 39 | 1.7 |

TABLE 45

Dose-dependent reduction of human ATXN2 RNA expression in SCA2-04 cells

| Compound Number | ATXN2 expression (% control) | | | | $IC_{50}$ (µM) |
|---|---|---|---|---|---|
| | 31.25 nM | 125.00 nM | 500.00 nM | 2,000.00 nM | |
| 708199 | 113 | 111 | 64 | 21 | 0.8 |
| 755237 | 159 | 151 | 97 | 38 | 1.9 |
| 755239 | 69 | 82 | 43 | 25 | 0.4 |
| 757028 | 110 | 158 | 145 | 53 | >2.0 |
| 757034 | 125 | 125 | 105 | 35 | 1.6 |
| 757037 | 142 | 151 | 117 | 49 | >2.0 |
| 757040 | 117 | 103 | 81 | 21 | 0.9 |
| 757045 | 254 | 153 | 113 | 35 | 1.6 |
| 757073 | 163 | 141 | 116 | 55 | >2.0 |
| 757075 | 120 | 102 | 81 | 48 | >2.0 |
| 757089 | 101 | 90 | 62 | 27 | 0.8 |
| 757094 | 202 | 161 | 86 | 34 | 1.3 |
| 757104 | 140 | 182 | 151 | 72 | >2.0 |
| 757116 | 100 | 93 | 69 | 42 | 1.5 |
| 757127 | 98 | 94 | 67 | 34 | 1.1 |
| 757129 | 89 | 83 | 67 | 37 | 1.2 |
| 757130 | 109 | 85 | 50 | 22 | 0.5 |
| 757131 | 152 | 103 | 66 | 30 | 0.9 |
| 757218 | 131 | 123 | 113 | 53 | >2.0 |

TABLE 46

Dose-dependent reduction of human ATXN2 RNA expression in SCA2-04 cells

| Compound Number | ATXN2 expression (% control) | | | | IC$_{50}$ (μM) |
|---|---|---|---|---|---|
| | 31.25 nM | 125.00 nM | 500.00 nM | 2,000.00 nM | |
| 708199 | 95 | 54 | 28 | 17 | 0.2 |
| 757161 | 100 | 95 | 61 | 32 | 0.9 |
| 757162 | 97 | 83 | 51 | 19 | 0.5 |
| 757175 | 101 | 84 | 60 | 25 | 0.7 |
| 757209 | 102 | 77 | 69 | 27 | 0.8 |
| 757210 | 112 | 95 | 51 | 30 | 0.7 |
| 757213 | 105 | 102 | 63 | 31 | 1.0 |
| 757219 | 112 | 89 | 67 | 37 | 1.1 |
| 757226 | 102 | 84 | 55 | 31 | 0.7 |
| 757228 | 92 | 104 | 65 | 36 | 1.3 |
| 757234 | 96 | 94 | 58 | 29 | 0.8 |
| 757250 | 85 | 92 | 64 | 46 | 2.0 |
| 757267 | 108 | 92 | 60 | 40 | 1.1 |
| 757272 | 95 | 88 | 48 | 35 | 0.7 |
| 757294 | 98 | 101 | 73 | 47 | >2.0 |
| 757311 | 91 | 62 | 55 | 24 | 0.4 |
| 757364 | 98 | 76 | 53 | 31 | 0.6 |
| 757371 | 107 | 97 | 73 | 38 | 1.4 |
| 757372 | 64 | 94 | 74 | 45 | 1.6 |

Example 5: Effect of 5-10-5 MOE Gapmers with Mixed Internucleoside Linkages on Human ATXN2 RNA Expression In Vitro, Multiple Doses Modified oligonucleotides selected from the examples above were tested at various doses in A431 cells. Cells were plated at a density of 10,000 cells per well and transfected by free uptake with 0.44 μM, 1.33 μM, 4.00 μM, and 12.00 μM concentrations of modified oligonucleotide, as specified in the tables below. After a treatment period of approximately 24 hours, total RNA was isolated from the cells and ATXN2 RNA levels were measured by quantitative real-time PCR Human ATXN2 primer probe set RTS5049 (described hereinabove in Example 2) was used to measure RNA levels. ATXN2 RNA levels were adjusted according to total RNA content, as measured by RIBOGREEN®. Results are presented in the tables below as percent ATXN2 RNA expression relative to untreated control. As illustrated in the tables below, ATXN2 RNA levels were reduced in a dose-dependent manner in modified oligonucleotide-treated cells. IC$_{50}$ was calculated using the "log(inhibitor) vs. response-variable slope (4 parameters)" formula using Prism6 software.

TABLE 47

Dose-dependent reduction of human ATXN2 RNA expression in A431 cells

| Compound Number | ATXN2 expression (% control) | | | | IC$_{50}$ (μM) |
|---|---|---|---|---|---|
| | 0.44 μM | 1.33 μM | 4.00 μM | 12.00 μM | |
| 708199 | 65 | 45 | 36 | 23 | 1.2 |
| 874225 | 89 | 72 | 64 | 52 | >12.0 |
| 874247 | 50 | 37 | 22 | 13 | <0.4 |
| 874248 | 67 | 54 | 45 | 32 | 2.2 |
| 874249 | 67 | 56 | 32 | 27 | 1.6 |
| 874272 | 64 | 51 | 35 | 27 | 1.4 |
| 874273 | 53 | 50 | 34 | 32 | 0.8 |
| 874702 | 34 | 25 | 16 | 13 | <0.4 |
| 874748 | 50 | 44 | 28 | 16 | 0.6 |
| 875060 | 63 | 44 | 27 | 14 | 1.0 |
| 875252 | 65 | 61 | 37 | 25 | 1.8 |
| 875325 | 105 | 80 | 61 | 46 | 8.4 |
| 875348 | 58 | 41 | 26 | 21 | 0.7 |
| 875398 | 54 | 33 | 20 | 11 | 0.5 |
| 875445 | 65 | 55 | 39 | 24 | 1.7 |
| 875733 | 65 | 54 | 41 | 33 | 1.9 |
| 875804 | 57 | 34 | 27 | 13 | 0.6 |
| 875805 | 83 | 70 | 58 | 45 | 7.6 |
| 875877 | 88 | 68 | 59 | 46 | 8.1 |

TABLE 48

Dose-dependent reduction of human ATXN2 RNA expression in A431 cells

| Compound Number | ATXN2 expression (% control) | | | | IC$_{50}$ (μM) |
|---|---|---|---|---|---|
| | 0.44 μM | 1.33 μM | 4.00 μM | 12.00 μM | |
| 708199 | 57 | 46 | 35 | 24 | 0.9 |
| 874250 | 60 | 51 | 33 | 21 | 1.1 |
| 874251 | 67 | 49 | 41 | 32 | 1.8 |
| 874297 | 82 | 82 | 69 | 53 | >12.0 |
| 874369 | 78 | 64 | 49 | 36 | 4.0 |
| 874415 | 62 | 56 | 38 | 26 | 1.6 |
| 874560 | 44 | 26 | 16 | 10 | <0.4 |
| 874703 | 75 | 59 | 47 | 24 | 2.5 |
| 874752 | 43 | 26 | 18 | 11 | <0.4 |
| 874799 | 70 | 63 | 43 | 28 | 2.5 |
| 875063 | 68 | 58 | 41 | 26 | 2.0 |
| 875328 | 27 | 15 | 9 | 7 | <0.4 |
| 875351 | 54 | 39 | 30 | 20 | 0.5 |
| 875352 | 80 | 66 | 52 | 40 | 5.1 |
| 875807 | 68 | 45 | 38 | 27 | 1.4 |
| 875831 | 61 | 50 | 44 | 36 | 1.7 |
| 875879 | 50 | 41 | 31 | 22 | 0.4 |
| 875880 | 61 | 50 | 37 | 30 | 1.3 |
| 875904 | 69 | 53 | 49 | 33 | 2.5 |

TABLE 49

Dose-dependent reduction of human ATXN2 RNA expression in A431 cells

| Compound Number | ATXN2 expression (% control) | | | | IC$_{50}$ (μM) |
|---|---|---|---|---|---|
| | 0.44 μM | 1.33 μM | 4.00 μM | 12.00 μM | |
| 708199 | 66 | 53 | 35 | 28 | 1.6 |
| 708399 | 87 | 77 | 55 | 33 | 5.1 |
| 874229 | 72 | 62 | 45 | 72 | >12.0 |
| 874254 | 72 | 63 | 49 | 35 | 3.5 |
| 874276 | 78 | 67 | 57 | 39 | 5.5 |
| 874277 | 60 | 48 | 46 | 41 | 1.8 |
| 874300 | 80 | 64 | 41 | 30 | 3.0 |
| 874610 | 58 | 45 | 24 | 13 | 0.8 |
| 874682 | 79 | 59 | 44 | 31 | 2.9 |
| 874706 | 57 | 39 | 26 | 13 | 0.7 |
| 874753 | 41 | 37 | 25 | 12 | <0.4 |
| 874754 | 52 | 40 | 24 | 11 | 0.5 |
| 874874 | 67 | 50 | 35 | 21 | 1.4 |
| 874969 | 74 | 55 | 36 | 17 | 1.8 |
| 875401 | 91 | 83 | 68 | 39 | 8.7 |
| 875427 | 74 | 49 | 38 | 23 | 1.8 |
| 875571 | 72 | 62 | 40 | 27 | 2.3 |
| 875834 | 69 | 58 | 45 | 37 | 3.0 |
| 875954 | 73 | 53 | 46 | 31 | 2.5 |

TABLE 50

Dose-dependent reduction of human ATXN2 RNA expression in A431 cells

| Compound Number | ATXN2 expression (% control) | | | | IC$_{50}$ (μM) |
|---|---|---|---|---|---|
| | 0.44 μM | 1.33 μM | 4.00 μM | 12.00 μM | |
| 708199 | 70 | 43 | 34 | 23 | 1.3 |
| 874211 | 65 | 50 | 39 | 33 | 1.7 |
| 874212 | 64 | 51 | 37 | 24 | 1.4 |
| 874279 | 68 | 54 | 39 | 20 | 1.6 |
| 874280 | 32 | 20 | 13 | 8 | <0.4 |
| 874281 | 48 | 39 | 22 | 14 | <0.4 |
| 874325 | 70 | 65 | 50 | 39 | 4.2 |
| 874327 | 55 | 36 | 32 | 25 | 0.5 |
| 874348 | 55 | 10 | 109 | 52 | >12.0 |
| 874541 | 3 | 3 | 31743 | 32 | <0.4 |
| 874685 | 81 | 78 | 56 | 46 | 8.6 |
| 874947 | 93 | 73 | 60 | 35 | 5.6 |
| 875404 | 61 | 54 | 39 | 22 | 1.4 |
| 875405 | 92 | 72 | 57 | 36 | 5.5 |
| 875452 | 62 | 42 | 26 | 14 | 0.9 |
| 875477 | 61 | 57 | 44 | 34 | 2.0 |
| 875572 | 44 | 36 | 29 | 72 | <0.4 |
| 875764 | 49 | 40 | 23 | 14 | <0.4 |
| 875956 | 75 | 55 | 50 | 45 | 4.8 |

TABLE 51

Dose-dependent reduction of human ATXN2 RNA expression in A431 cells

| Compound Number | ATXN2 expression (% control) | | | | IC$_{50}$ (μM) |
|---|---|---|---|---|---|
| | 0.44 μM | 1.33 μM | 4.00 μM | 12.00 μM | |
| 708199 | 80 | 49 | 37 | 23 | 2.0 |
| 874258 | 74 | 67 | 45 | 52 | >12.0 |
| 874282 | 41 | 36 | 21 | 13 | <0.4 |
| 874283 | 73 | 44 | 33 | 24 | 1.5 |
| 874591 | 79 | 66 | 53 | 50 | 8.4 |
| 874615 | 74 | 64 | 45 | 33 | 3.1 |
| 874639 | 46 | 30 | 17 | 10 | <0.4 |
| 874782 | 57 | 46 | 36 | 26 | 0.9 |
| 874806 | 84 | 84 | 61 | 47 | 11.1 |
| 874807 | 76 | 61 | 53 | 38 | 4.3 |
| 874856 | 78 | 59 | 34 | 28 | 2.3 |
| 874903 | 67 | 59 | 40 | 33 | 2.2 |
| 874951 | 72 | 61 | 52 | 42 | 4.8 |
| 874952 | 60 | 43 | 27 | 19 | 0.9 |
| 874999 | 93 | 77 | 55 | 29 | 4.6 |
| 875360 | 61 | 42 | 29 | 22 | 0.8 |
| 875670 | 84 | 63 | 49 | 28 | 3.3 |
| 875886 | 76 | 60 | 42 | 25 | 2.4 |
| 875959 | 75 | 58 | 41 | 37 | 2.9 |

TABLE 52

Dose-dependent reduction of human ATXN2 RNA expression in A431 cells

| Compound Number | ATXN2 expression (% control) | | | | IC$_{50}$ (μM) |
|---|---|---|---|---|---|
| | 0.44 μM | 1.33 μM | 4.00 μM | 12.00 μM | |
| 708199 | 74 | 44 | 32 | 25 | 1.5 |
| 874216 | 81 | 55 | n.d. | 16 | 2.0 |
| 874217 | 51 | 40 | 29 | 26 | <0.4 |
| 874237 | 66 | 59 | 43 | 30 | 2.2 |
| 874238 | 86 | 58 | 42 | 37 | 3.4 |
| 874307 | 173 | 64 | 64 | 68 | >12.0 |
| 874544 | 92 | 78 | 71 | 54 | >12.0 |
| 874547 | 80 | 59 | 46 | 34 | 3.3 |
| 874568 | 77 | 59 | 42 | 32 | 2.8 |
| 874571 | 106 | 79 | 55 | 38 | 5.9 |
| 874643 | 85 | 62 | 40 | 35 | 3.3 |
| 874738 | 65 | 46 | 37 | 25 | 1.3 |
| 874785 | 71 | 58 | 38 | 25 | 2.0 |
| 874858 | 93 | 86 | 65 | 66 | >12.0 |
| 875458 | 42 | 28 | 19 | 12 | <0.4 |
| 875650 | 63 | 46 | 31 | 19 | 1.1 |
| 875793 | 89 | 93 | 78 | 64 | >12.0 |
| 875840 | 97 | 81 | 79 | 48 | >12.0 |
| 875914 | 60 | 48 | 42 | 38 | 1.5 |

TABLE 53

Dose-dependent reduction of human ATXN2 RNA expression in A431 cells

| Compound Number | ATXN2 expression (% control) | | | | IC$_{50}$ (μM) |
|---|---|---|---|---|---|
| | 0.44 μM | 1.33 μM | 4.00 μM | 12.00 μM | |
| 708199 | 59 | 44 | 29 | 21 | 0.8 |
| 874288 | 64 | 40 | n.d. | 16 | 0.9 |
| 874334 | 57 | 38 | 29 | 28 | 0.6 |
| 874335 | 56 | 37 | 32 | 27 | 0.6 |
| 874430 | 60 | 49 | 32 | 25 | 1.1 |
| 874501 | 54 | 41 | 33 | 21 | 0.6 |
| 874548 | 68 | 49 | 34 | 23 | 1.4 |
| 874669 | 40 | 20 | 12 | 10 | <0.4 |
| 874764 | 77 | 53 | 51 | 33 | 3.1 |
| 875148 | 60 | 43 | 39 | 26 | 1.0 |
| 875196 | 84 | 85 | 64 | 38 | 7.8 |
| 875315 | 63 | 54 | 36 | 31 | 1.6 |
| 875341 | 62 | 40 | 30 | 20 | 0.9 |
| 875389 | 66 | 56 | 38 | 29 | 1.8 |
| 875485 | 52 | 23 | 16 | 13 | <0.4 |
| 875508 | 63 | 57 | 48 | 33 | 2.4 |
| 875798 | 59 | 42 | 31 | 17 | 0.8 |
| 875820 | 72 | 67 | 45 | 35 | 3.4 |
| 875966 | 45 | 31 | 24 | 19 | <0.4 |

TABLE 54

Dose-dependent reduction of human ATXN2 RNA expression in A431 cells

| Compound Number | ATXN2 expression (% control) | | | | IC$_{50}$ (μM) |
|---|---|---|---|---|---|
| | 0.44 μM | 1.33 μM | 4.00 μM | 12.00 μM | |
| 708199 | 59 | 47 | 28 | 20 | 0.9 |
| 874359 | 84 | 65 | n.d. | 16 | 6.1 |
| 874360 | 75 | 62 | 43 | 38 | 3.3 |
| 874384 | 50 | 47 | 34 | 32 | <0.4 |
| 874385 | 50 | 35 | 29 | 31 | <0.4 |
| 874503 | 32 | 21 | 14 | 6 | <0.4 |
| 874745 | 65 | 41 | 27 | 16 | 1.0 |
| 874792 | 58 | 39 | 26 | 19 | 0.7 |
| 874937 | 64 | 55 | 30 | 22 | 1.4 |
| 875032 | 35 | 21 | 11 | 6 | <0.4 |
| 875319 | 53 | 36 | 22 | 15 | 0.5 |
| 875414 | 68 | 59 | 42 | 28 | 2.2 |
| 875416 | 74 | 58 | 48 | 35 | 3.3 |
| 875512 | 68 | 57 | 42 | 31 | 2.2 |
| 875680 | 47 | 32 | 22 | 15 | <0.4 |
| 875799 | 49 | 39 | 26 | 14 | <0.4 |
| 875822 | 62 | 53 | 39 | 27 | 1.5 |
| 875895 | 76 | 52 | 41 | 33 | 2.4 |
| 875991 | 65 | 48 | 40 | 27 | 1.5 |

TABLE 55

Dose-dependent reduction of human ATXN2 RNA expression in A431 cells

| Compound Number | ATXN2 expression (% control) | | | | $IC_{50}$ (µM) |
|---|---|---|---|---|---|
| | 0.44 µM | 1.33 µM | 4.00 µM | 12.00 µM | |
| 708199 | 56 | 50 | 36 | 23 | 1.0 |
| 874244 | 85 | 82 | n.d. | 16 | >12.0 |
| 874246 | 53 | 40 | 30 | 23 | 0.5 |
| 874388 | 54 | 51 | 41 | 29 | 1.0 |
| 874506 | 44 | 24 | 17 | 8 | <0.4 |
| 874554 | 30 | 17 | 10 | 4 | <0.4 |
| 874627 | 33 | 28 | 17 | 10 | <0.4 |
| 874674 | 83 | 75 | 62 | 45 | 9.4 |
| 874699 | 60 | 39 | 23 | 17 | 0.7 |
| 874771 | 28 | 19 | 10 | 7 | <0.4 |
| 874842 | 60 | 44 | 29 | 20 | 0.9 |
| 874939 | 45 | 34 | 21 | 15 | <0.4 |
| 875083 | 74 | 57 | 46 | 26 | 2.4 |
| 875346 | 55 | 52 | 38 | 26 | 1.0 |
| 875347 | 47 | 35 | 39 | 26 | <0.4 |
| 875489 | 75 | 71 | 45 | 37 | 3.9 |
| 875490 | 76 | 68 | 52 | 31 | 3.7 |
| 875681 | 81 | 76 | 61 | 39 | 7.0 |
| 875803 | 63 | 53 | 38 | 22 | 1.4 |

Example 6: Effect of 5-10-5 MOE Gapmers with Mixed Internucleoside Linkages on Human ATXN2 In Vitro, Multiple Doses Modified oligonucleotides selected from the examples above were tested at various doses in A431 cells. Cells were plated at a density of 10,000 cells per well and transfected by free uptake with 0.094, 0.375, 1.500, and 6.000 µM concentrations of modified oligonucleotide, as specified in the tables below. After a treatment period of approximately 24 hours, total RNA was isolated from the cells and ATXN2 RNA levels were measured by quantitative real-time PCR. Human ATXN2 primer probe set RTS5049 (described hereinabove in Example 2) was used to measure RNA levels. ATXN2 RNA levels were adjusted according to total RNA content, as measured by RIBOGREEN®. Results are presented in the tables below as percent ATXN2 RNA expression relative to untreated control cells. As illustrated in the tables below, ATXN2 RNA levels were reduced in a dose-dependent manner in modified oligonucleotide-treated cells. $IC_{50}$ was calculated using the "log(inhibitor) vs. response–variable slope (4 parameters)" formula using Prism6 software.

TABLE 56

Dose-dependent reduction of human ATXN2 RNA expression in A431 cells

| Compound Number | ATXN2 expression (% control) | | | | $IC_{50}$ (µM) |
|---|---|---|---|---|---|
| | 0.094 µM | 0.375 µM | 1.500 µM | 6.000 µM | |
| 708199 | 72 | 52 | 28 | 14 | 0.4 |
| 937383 | 52 | 26 | n.d. | 16 | <0.1 |
| 937430 | 60 | 24 | 10 | 4 | 0.1 |
| 937466 | 85 | 62 | 34 | 19 | 0.7 |
| 937467 | 74 | 52 | 26 | 12 | 0.4 |
| 937478 | 66 | 44 | 23 | 12 | 0.3 |
| 937479 | 66 | 35 | 17 | 9 | 0.2 |
| 937611 | 79 | 54 | 31 | 15 | 0.5 |
| 937634 | 76 | 51 | 24 | 11 | 0.4 |
| 937754 | 73 | 34 | 10 | 3 | 0.2 |
| 937791 | 77 | 47 | 22 | 10 | 0.4 |
| 937934 | 65 | 37 | 16 | 8 | 0.2 |
| 937983 | 69 | 34 | 14 | 5 | 0.2 |
| 938042 | 91 | 58 | 27 | 17 | 0.7 |
| 938043 | 55 | 28 | 13 | 5 | 0.1 |
| 938151 | 70 | 48 | 27 | 12 | 0.3 |
| 938163 | 67 | 38 | 15 | 6 | 0.2 |
| 938174 | 97 | 67 | 31 | 15 | 0.9 |
| 938210 | 65 | 33 | 14 | 8 | 0.2 |

TABLE 57

Dose-dependent reduction of human ATXN2 RNA expression in A431 cells

| Compound Number | ATXN2 expression (% control) | | | | $IC_{50}$ (µM) |
|---|---|---|---|---|---|
| | 0.094 µM | 0.375 µM | 1.500 µM | 6.000 µM | |
| 708199 | 79 | 51 | 26 | 15 | 0.5 |
| 937385 | 33 | 15 | n.d. | 16 | <0.1 |
| 937420 | 68 | 38 | 20 | 10 | 0.2 |
| 937422 | 55 | 24 | 9 | 5 | <0.1 |
| 937456 | 76 | 51 | 21 | 8 | 0.4 |
| 937468 | 52 | 21 | 8 | 3 | <0.1 |
| 937470 | 51 | 25 | 9 | 3 | <0.1 |
| 937480 | 41 | 22 | 9 | 5 | <0.1 |
| 937494 | 85 | 64 | 34 | 16 | 0.7 |
| 937552 | 76 | 41 | 19 | 7 | 0.3 |
| 937578 | 76 | 39 | 23 | 10 | 0.3 |
| 937683 | 73 | 46 | 24 | 14 | 0.4 |
| 937792 | 73 | 39 | 21 | 9 | 0.3 |
| 937794 | 35 | 9 | 4 | 2 | <0.1 |
| 937804 | 68 | 42 | 19 | 7 | 0.3 |
| 937936 | 49 | 19 | 6 | 2 | <0.1 |
| 937938 | 63 | 31 | 15 | 11 | 0.1 |
| 937972 | 55 | 32 | 15 | 5 | 0.1 |
| 938044 | 66 | 39 | 24 | 10 | 0.2 |

TABLE 58

Dose-dependent reduction of human ATXN2 RNA expression in A431 cells

| Compound Number | ATXN2 expression (% control) | | | | $IC_{50}$ (µM) |
|---|---|---|---|---|---|
| | 0.094 µM | 0.375 µM | 1.500 µM | 6.000 µM | |
| 708199 | 77 | 45 | 27 | 16 | 0.4 |
| 937365 | 63 | 36 | n.d. | 16 | 0.2 |
| 937423 | 81 | 41 | 20 | 11 | 0.4 |
| 937424 | 67 | 37 | 19 | 11 | 0.2 |
| 937436 | 82 | 39 | 15 | 5 | 0.3 |
| 937471 | 57 | 20 | 7 | 2 | <0.1 |
| 937508 | 78 | 52 | 23 | 8 | 0.4 |
| 937579 | 61 | 35 | 14 | 7 | 0.2 |
| 937591 | 50 | 28 | 9 | 4 | <0.1 |
| 937592 | 67 | 35 | 15 | 6 | 0.2 |
| 937639 | 64 | 39 | 15 | 7 | 0.2 |
| 937748 | 83 | 55 | 21 | 10 | 0.5 |
| 937795 | 60 | 28 | 11 | 6 | 0.1 |
| 937796 | 76 | 55 | 23 | 11 | 0.4 |
| 937939 | 39 | 20 | 10 | 5 | <0.1 |
| 937940 | 63 | 28 | 12 | 6 | 0.1 |
| 937962 | 90 | 62 | 32 | 13 | 0.7 |
| 937987 | 77 | 46 | 24 | 14 | 0.4 |
| 938238 | 87 | 55 | 40 | 20 | 0.8 |

TABLE 59

Dose-dependent reduction of human ATXN2 RNA expression in A431 cells

| Compound Number | ATXN2 expression (% control) | | | | $IC_{50}$ ($\mu$M) |
|---|---|---|---|---|---|
| | 0.094 $\mu$M | 0.375 $\mu$M | 1.500 $\mu$M | 6.000 $\mu$M | |
| 708199 | 80 | 46 | 29 | 13 | 0.4 |
| 937378 | 66 | 37 | n.d. | 16 | 0.2 |
| 937389 | 64 | 38 | 19 | 15 | 0.2 |
| 937425 | 63 | 40 | 18 | 9 | 0.2 |
| 937437 | 82 | 53 | 19 | 7 | 0.4 |
| 937472 | 86 | 52 | 34 | 16 | 0.6 |
| 937509 | 86 | 53 | 28 | 12 | 0.6 |
| 937510 | 76 | 51 | 21 | 8 | 0.4 |
| 937546 | 73 | 43 | 20 | 9 | 0.3 |
| 937580 | 68 | 40 | 20 | 12 | 0.2 |
| 937593 | 68 | 39 | 15 | 5 | 0.2 |
| 937618 | 50 | 24 | 13 | 6 | <0.1 |
| 937725 | 84 | 48 | 24 | 12 | 0.5 |
| 937737 | 70 | 38 | 20 | 12 | 0.2 |
| 937738 | 62 | 35 | 15 | 6 | 0.2 |
| 937941 | 73 | 53 | 29 | 13 | 0.4 |
| 937942 | 67 | 45 | 19 | 10 | 0.3 |
| 937989 | 65 | 42 | 16 | 8 | 0.2 |
| 938170 | 53 | 23 | 10 | 4 | <0.1 |

TABLE 60

Dose-dependent reduction of human ATXN2 RNA expression in A431 cells

| Compound Number | ATXN2 expression (% control) | | | | $IC_{50}$ ($\mu$M) |
|---|---|---|---|---|---|
| | 0.094 $\mu$M | 0.375 $\mu$M | 1.500 $\mu$M | 6.000 $\mu$M | |
| 708199 | 74 | 45 | 24 | 15 | 0.4 |
| 937426 | 84 | 63 | n.d. | 16 | 0.6 |
| 937428 | 63 | 41 | 20 | 10 | 0.2 |
| 937474 | 74 | 42 | 19 | 9 | 0.3 |
| 937511 | 82 | 51 | 24 | 18 | 0.5 |
| 937547 | 67 | 41 | 14 | 5 | 0.2 |
| 937572 | 74 | 46 | 21 | 9 | 0.3 |
| 937595 | 95 | 66 | 39 | 16 | 0.9 |
| 937619 | 63 | 39 | 14 | 7 | 0.2 |
| 937620 | 61 | 37 | 18 | 10 | 0.2 |
| 937666 | 79 | 41 | 23 | 13 | 0.4 |
| 937680 | 70 | 38 | 17 | 7 | 0.3 |
| 937739 | 86 | 49 | 22 | 10 | 0.5 |
| 937918 | 73 | 41 | 21 | 12 | 0.3 |
| 937991 | 75 | 49 | 20 | 12 | 0.4 |
| 938004 | 51 | 20 | 10 | 4 | <0.1 |
| 938136 | 68 | 38 | 20 | 7 | 0.2 |
| 938171 | 83 | 54 | 28 | 11 | 0.5 |
| 938172 | 78 | 44 | 20 | 9 | 0.4 |

TABLE 61

Dose-dependent reduction of human ATXN2 RNA expression in A431 cells

| Compound Number | ATXN2 expression (% control) | | | | $IC_{50}$ ($\mu$M) |
|---|---|---|---|---|---|
| | 0.094 $\mu$M | 0.375 $\mu$M | 1.500 $\mu$M | 6.000 $\mu$M | |
| 708199 | 80 | 48 | 30 | 14 | 0.5 |
| 937374 | 78 | 42 | n.d. | 16 | 0.4 |
| 937397 | 52 | 27 | 18 | 13 | <0.1 |
| 937421 | 72 | 35 | 13 | 5 | 0.2 |
| 937429 | 43 | 15 | 5 | 3 | <0.1 |
| 937465 | 41 | 14 | 6 | 3 | <0.1 |
| 937469 | 62 | 28 | 9 | 3 | 0.1 |
| 937477 | 75 | 49 | 21 | 10 | 0.4 |
| 937481 | 48 | 18 | 7 | 3 | <0.1 |
| 937621 | 69 | 45 | 24 | 12 | 0.3 |
| 937633 | 68 | 41 | 19 | 7 | 0.3 |
| 937933 | 93 | 42 | 23 | 12 | 0.5 |
| 937937 | 71 | 42 | 23 | 12 | 0.3 |
| 937973 | 53 | 22 | 7 | 3 | <0.1 |
| 938041 | 77 | 49 | 24 | 9 | 0.4 |
| 938045 | 73 | 50 | 27 | 11 | 0.4 |
| 938173 | 78 | 45 | 21 | 8 | 0.4 |
| 938221 | 58 | 26 | 14 | 7 | 0.1 |
| 938237 | 54 | 23 | 11 | 7 | <0.1 |

Example 7: Design of Gapmers with Mixed Internucleoside Linkages Complementary to Human ATXN2 RNA Modified oligonucleotides complementary to a human ATXN2 nucleic acid were designed. The modified oligonucleotides in the table below are gapmers. The gapmers have a central gap segment that comprises 2'-deoxynucleosides and is flanked by wing segments on both the 5' end on the 3' end comprising 2'-MOE nucleosides. The internucleoside linkages are mixed phosphodiester internucleoside linkages and phosphorothioate internucleoside linkages. Each cytosine residue is a 5-methyl cytosine. The sequence and chemical notation column specifies the sequence, including 5-methyl cytosines, sugar chemistry, and the internucleoside linkage chemistry, wherein subscript 'd' represents a 2'-deoxyribose sugar; subscript 'e' represents a 2'-MOE modified sugar; subscript 'o' represents a phosphodiester internucleoside linkage; subscript 's' represents a phosphorothioate internucleoside linkage; and a 'm' superscript before the cytosine residue indicates a 5-methyl cytosine. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in the table below is complementary to human ATXN2 nucleic acid sequence SEQ ID NO: 1 or SEQ ID NO: 2, as indicated. 'N/A' indicates that the modified oligonucleotide is not complementary to that particular nucleic acid with 100% complementarity.

TABLE 62

Modified oligonucleotides complementary to human ATXN2 RNA

| Compound Number | Gapmer motif | Sequence and chemistry notation (5' to 3') | SEQ ID NO: 1 Start Site | SEQ ID NO: 1 Stop Site | SEQ ID NO: 2 Start Site | SEQ ID NO: 2 Stop Site | SEQ ID NO: |
|---|---|---|---|---|---|---|---|
| 702063 | 5-10-5 | $^{m}C_{es} T_{eo}\ ^{m}C_{eo} T_{eo}\ ^{m}C_{es}\ ^{m}C_{ds} A_{ds} T_{ds} T_{ds} A_{ds} T_{ds}$ $T_{ds} T_{ds}\ ^{m}C_{ds} T_{ds} T_{eo}\ ^{m}C_{eo} A_{es}\ ^{m}C_{es} G_{e}$ | 1123 | 1142 | 49297 | 49316 | 33 |

TABLE 62-continued

Modified oligonucleotides complementary to human ATXN2 RNA

| Compound Number | Gapmer motif | Sequence and chemistry notation (5' to 3') | SEQ ID NO: 1 Start Site | SEQ ID NO: 1 Stop Site | SEQ ID NO: 2 Start Site | SEQ ID NO: 2 Stop Site | SEQ ID NO: |
|---|---|---|---|---|---|---|---|
| 708154 | 5-10-5 | $T_{es} G_{eo} G_{eo} A_{eo} T_{eo} T_{ds} {}^mC_{ds} T_{ds} G_{ds} T_{ds} A_{ds} {}^mC_{ds} T_{ds} T_{ds} T_{ds} T_{eo} {}^mC_{eo} T_{es} {}^mC_{es} A_e$ | 1089 | 1108 | 49263 | 49282 | 3235 |
| 755235 | 5-10-5 | ${}^mC_{es} T_{eo} G_{eo} G_{eo} A_{eo} T_{ds} T_{ds} {}^mC_{ds} T_{ds} G_{ds} T_{ds} A_{ds} {}^mC_{ds} T_{ds} T_{ds} T_{eo} T_{eo} {}^mC_{es} T_{es} {}^mC_e$ | 1090 | 1109 | 49264 | 49283 | 3234 |
| 760771 | 5-8-5 | $T_{es} G_{eo} {}^mC_{eo} {}^mC_{eo} T_{es} {}^mC_{ds} T_{ds} A_{ds} {}^mC_{ds} T_{ds} {}^mC_{ds} G_{ds} T_{eo} {}^mC_{eo} {}^mC_{es} A_{es} A_e$ | 4274 | 4291 | 149025 | 149042 | 3292 |
| 874430 | 5-10-5 | $G_{es} T_{eo} T_{eo} A_{eo} {}^mC_{eo} T_{ds} G_{ds} T_{ds} T_{ds} T_{ds} {}^mC_{ds} G_{ds} A_{ds} {}^mC_{ds} {}^mC_{ds} T_{eo} {}^mC_{eo} G_{es} G_{es} A_e$ | N/A | N/A | N/A | N/A | 3293 |
| 1008800 | 5-8-5 | $T_{es} G_{eo} T_{eo} A_{eo} {}^mC_{es} T_{ds} T_{ds} T_{ds} T_{ds} {}^mC_{ds} T_{ds} {}^mC_{ds} A_{ds} T_{eo} G_{eo} T_{es} G_{es} {}^mC_e$ | 1084 | 1101 | 49258 | 49275 | 3232 |
| 1008806 | 5-8-5 | $G_{es} G_{eo} A_{eo} T_{eo} T_{es} {}^mC_{ds} T_{ds} G_{ds} T_{ds} A_{ds} {}^mC_{ds} T_{ds} T_{ds} T_{eo} T_{eo} {}^mC_{es} T_{es} {}^mC_e$ | 1090 | 1107 | 49264 | 49281 | 3233 |
| 1008845 | 4-10-6 | $T_{es} A_{eo} {}^mC_{eo} T_{eo} T_{ds} T_{ds} T_{ds} {}^mC_{ds} T_{ds} {}^mC_{ds} A_{ds} T_{ds} G_{ds} T_{ds} G_{eo} {}^mC_{eo} G_{eo} G_{es} {}^mC_{es} A_e$ | 1080 | 1099 | 49254 | 49273 | 1637 |
| 1008852 | 4-10-6 | ${}^mC_{es} T_{eo} G_{eo} G_{eo} A_{ds} T_{ds} T_{ds} {}^mC_{ds} T_{ds} G_{ds} T_{ds} A_{ds} {}^mC_{ds} T_{ds} T_{eo} T_{eo} T_{eo} {}^mC_{es} T_{es} {}^mC_e$ | 1090 | 1109 | 49264 | 49283 | 3234 |
| 1008854 | 4-10-6 | ${}^mC_{es} T_{eo} G_{eo} {}^mC_{eo} T_{ds} A_{ds} A_{ds} {}^mC_{ds} T_{ds} G_{ds} G_{ds} T_{ds} T_{ds} T_{ds} G_{eo} {}^mC_{eo} {}^mC_{eo} {}^mC_{es} T_{es} T_e$ | 1479 | 1498 | 81639 | 81658 | 1255 |
| 1008858 | 6-10-4 | ${}^mC_{es} T_{eo} T_{eo} A_{eo} G_{eo} A_{eo} G_{ds} T_{ds} T_{ds} T_{ds} T_{ds} G_{ds} {}^mC_{ds} {}^mC_{ds} T_{ds} T_{eo} {}^mC_{es} {}^mC_{es} A_e$ | N/A | N/A | 9931 | 9950 | 3087 |
| 1008859 | 6-10-4 | $G_{es} {}^mC_{eo} T_{eo} T_{eo} A_{eo} G_{eo} A_{ds} G_{ds} T_{ds} T_{ds} T_{ds} T_{ds} T_{ds} G_{ds} {}^mC_{ds} {}^mC_{ds} T_{eo} {}^mC_{es} {}^mC_e$ | N/A | N/A | 9932 | 9951 | 2177 |
| 1008860 | 6-10-4 | $A_{es} G_{eo} {}^mC_{eo} T_{eo} T_{eo} A_{eo} G_{ds} A_{ds} G_{ds} T_{ds} T_{ds} T_{ds} T_{ds} T_{ds} G_{ds} {}^mC_{ds} {}^mC_{eo} T_{es} T_{es} {}^mC_e$ | N/A | N/A | 9933 | 9952 | 3164 |
| 1008861 | 6-10-4 | ${}^mC_{es} G_{eo} T_{eo} A_{eo} T_{eo} G_{eo} T_{ds} T_{ds} T_{ds} G_{ds} T_{ds} {}^mC_{ds} G_{ds} G_{ds} T_{ds} {}^mC_e T_{eo} A_{es} T_e$ | N/A | N/A | 33816 | 33835 | 2262 |
| 1008862 | 6-10-4 | $T_{es} G_{eo} T_{eo} A_{eo} {}^mC_{eo} T_{eo} T_{ds} {}^mC_{ds} A_{ds} {}^mC_{ds} A_{ds} T_{ds} T_{ds} T_{ds} G_{ds} G_{ds} A_{eo} G_{es} {}^mC_{es} {}^mC_e$ | 991 | 1010 | 48690 | 48709 | 1185 |
| 1008863 | 6-10-4 | $A_{es} {}^mC_{eo} T_{eo} T_{eo} T_{eo} T_{eo} {}^mC_{ds} T_{ds} {}^mC_{ds} A_{ds} T_{ds} G_{ds} T_{ds} G_{ds} {}^mC_{ds} G_{ds} G_{eo} {}^mC_e A_{es} T_e$ | 1079 | 1098 | 49253 | 49272 | 1561 |
| 1008864 | 6-10-4 | $T_{es} A_{eo} {}^mC_{eo} T_{eo} T_{eo} T_{eo} T_{ds} {}^mC_{ds} T_{ds} {}^mC_{ds} A_{ds} T_{ds} G_{ds} T_{ds} G_{ds} {}^mC_{ds} G_{eo} G_{es} {}^mC_e A_e$ | 1080 | 1099 | 49254 | 49273 | 1637 |
| 1008865 | 6-10-4 | $T_{es} {}^mC_{eo} T_{eo} G_{eo} T_{eo} A_{eo} {}^mC_{ds} T_{ds} T_{ds} T_{ds} T_{ds} {}^mC_{ds} T_{ds} {}^mC_{ds} A_{ds} T_{ds} G_{eo} T_{es} G_{es} {}^mC_e$ | 1084 | 1103 | 49258 | 49277 | 2544 |
| 1008866 | 6-10-4 | $T_{es} T_{eo} {}^mC_{eo} T_{eo} {}^mC_{eo} T_{eo} A_{ds} T_{ds} T_{ds} T_{ds} {}^mC_{ds} T_{ds} T_{ds} G_{ds} T_{ds} {}^mC_{eo} {}^mC_{es} A_{es} G_e$ | 1649 | 1668 | 83260 | 83279 | 804 |
| 1008867 | 6-10-4 | $A_{es} {}^mC_{eo} A_{eo} {}^mC_{eo} A_{eo} G_{eo} T_{ds} T_{ds} T_{ds} {}^mC_{ds} A_{ds} {}^mC_{ds} T_{ds} A_{ds} G_{ds} G_{ds} T_{eo} T_{es} {}^mC_{es} T_e$ | N/A | N/A | 57472 | 57491 | 2503 |
| 1008868 | 6-10-4 | $T_{es} G_{eo} G_{eo} G_{eo} G_{eo} G_{eo} T_{ds} G_{ds} G_{ds} T_{ds} G_{ds} {}^mC_{ds} {}^mC_{ds} A_{ds} T_{ds} G_{ds} T_{eo} A_{es} G_{es} A_e$ | N/A | N/A | 9003 | 9022 | 1800 |
| 1008869 | 6-10-4 | $G_{es} T_{eo} T_{eo} A_{eo} {}^mC_{eo} T_{eo} G_{ds} T_{ds} T_{ds} T_{ds} {}^mC_{ds} G_{ds} A_{ds} {}^mC_{ds} {}^mC_{ds} T_{ds} {}^mC_{eo} T_{es} G_{es} A_e$ | N/A | N/A | 45744 | 45763 | 3291 |
| 1008870 | 6-10-4 | $T_{es} G_{eo} G_{eo} A_{eo} T_{eo} T_{eo} {}^mC_{ds} T_{ds} G_{ds} T_{ds} A_{ds} {}^mC_{ds} T_{ds} T_{ds} T_{ds} T_{ds} {}^mC_{eo} T_{es} {}^mC_{es} A_e$ | 1089 | 1108 | 49263 | 49282 | 3235 |
| 1008871 | 6-10-4 | ${}^mC_{es} T_{eo} G_{eo} G_{eo} A_{eo} T_{eo} T_{ds} {}^mC_{ds} T_{ds} G_{ds} T_{ds} A_{ds} {}^mC_{ds} T_{ds} T_{ds} T_{ds} T_{eo} {}^mC_{es} T_{es} {}^mC_e$ | 1090 | 1109 | 49264 | 49283 | 3234 |
| 1008872 | 6-10-4 | ${}^mC_{es} T_{eo} {}^mC_{eo} T_{eo} {}^mC_{eo} {}^mC_{eo} A_{ds} T_{ds} T_{ds} A_{ds} {}^mC_{ds} T_{ds} T_{ds} {}^mC_{ds} A_{ds} {}^mC_{eo} A_{es} {}^mC_{es} G_e$ | 1123 | 1142 | 49297 | 49316 | 33 |
| 1008873 | 6-10-4 | ${}^mC_{es} T_{eo} G_{eo} {}^mC_{eo} T_{eo} A_{eo} A_{ds} {}^mC_{ds} T_{ds} G_{ds} G_{ds} T_{ds} T_{ds} T_{ds} G_{ds} {}^mC_{ds} {}^mC_{eo} {}^mC_{es} T_{es} T_e$ | 1479 | 1498 | 81639 | 81658 | 1255 |
| 1008874 | 6-10-4 | ${}^mC_{es} {}^mC_{eo} T_{eo} T_{eo} A_{eo} T_{eo} {}^mC_{eo} A_{ds} T_{ds} {}^mC_{ds} A_{ds} T_{ds} T_{ds} T_{ds} {}^mC_{ds} {}^mC_{ds} A_{eo} G_{es} G_{es} G_e$ | 1538 | 1557 | 81698 | 81717 | 158 |
| 1008875 | 6-10-4 | $A_{es} {}^mC_{eo} T_{eo} T_{eo} {}^mC_{eo} T_{eo} {}^mC_{ds} T_{ds} A_{ds} T_{ds} T_{ds} T_{ds} {}^mC_{ds} T_{ds} T_{ds} T_{ds} G_{eo} T_{es} {}^mC_{es} {}^mC_e$ | 1651 | 1670 | 83262 | 83281 | 172 |
| 1008876 | 6-10-4 | $G_{es} T_{eo} G_{eo} A_{eo} T_{eo} G_{eo} T_{ds} T_{ds} T_{ds} {}^mC_{ds} A_{ds} T_{ds} T_{ds} G_{ds} G_{ds} G_{ds} T_{eo} T_{es} T_{es} A_e$ | 2460 | 2479 | 91730 | 91749 | 1188 |
| 1008877 | 5-10-5 | $G_{es} T_{eo} A_{eo} T_{eo} G_{eo} T_{ds} T_{ds} T_{ds} T_{ds} G_{ds} T_{ds} {}^mC_{ds} T_{ds} G_{ds} T_{ds} {}^mC_{ds} T_{eo} T_{eo} A_{es} T_{es} T_e$ | N/A | N/A | 33815 | 33834 | 3294 |
| 1008878 | 5-10-5 | $T_{es} {}^mC_{eo} G_{eo} T_{eo} A_{eo} T_{ds} G_{ds} T_{ds} T_{ds} T_{ds} G_{ds} T_{ds} {}^mC_{ds} T_{ds} G_{ds} T_{eo} {}^mC_{eo} T_{es} T_{es} A_e$ | N/A | N/A | 33817 | 33836 | 3295 |
| 1008879 | 5-10-5 | $A_{es} {}^mC_{eo} T_{eo} T_{eo} {}^mC_{eo} A_{ds} T_{ds} {}^mC_{ds} A_{ds} A_{ds} T_{ds} T_{ds} T_{ds} G_{ds} G_{ds} A_{ds} G_{ds} {}^mC_{eo} {}^mC_{eo} {}^mC_{es} T_{es} A_e$ | N/A | N/A | 48687 | 48706 | 3296 |
| 1008880 | 5-10-5 | $T_{es} A_{eo} {}^mC_{eo} T_{eo} T_{eo} {}^mC_{ds} A_{ds} T_{ds} {}^mC_{ds} A_{ds} T_{ds} T_{ds} T_{ds} T_{ds} G_{ds} G_{ds} A_{ds} G_{eo} {}^mC_{eo} {}^mC_{es} {}^mC_{es} T_e$ | N/A | N/A | 48688 | 48707 | 3297 |
| 1008881 | 5-10-5 | $G_{es} T_{eo} A_{eo} {}^mC_{eo} T_{eo} T_{ds} {}^mC_{ds} A_{ds} {}^mC_{ds} A_{ds} T_{ds} T_{ds} T_{ds} G_{ds} G_{ds} A_{eo} G_{eo} {}^mC_{es} {}^mC_{es} {}^mC_e$ | N/A | N/A | 48689 | 48708 | 3236 |
| 1008882 | 5-10-5 | $A_{es} T_{eo} A_{eo} T_{eo} {}^mC_{eo} G_{ds} T_{ds} A_{ds} A_{ds} {}^mC_{ds} T_{ds} T_{ds} T_{ds} {}^mC_{ds} T_{ds} {}^mC_{eo} A_{eo} T_{es} G_{es} T_e$ | 1086 | 1105 | 49260 | 49279 | 3298 |
| 1008883 | 5-10-5 | $G_{es} T_{eo} T_{eo} A_{eo} {}^mC_{eo} T_{ds} G_{ds} T_{ds} T_{ds} T_{ds} {}^mC_{ds} G_{ds} A_{ds} {}^mC_{ds} {}^mC_{ds} T_{eo} {}^mC_{eo} T_{es} G_{es} A_e$ | N/A | N/A | 45744 | 45763 | 3291 |
| 1008884 | 5-10-5 | $A_{es} {}^mC_{eo} T_{eo} G_{eo} G_{eo} A_{ds} T_{ds} T_{ds} {}^mC_{ds} T_{ds} G_{ds} T_{ds} A_{ds} {}^mC_{ds} T_{ds} T_{eo} T_{eo} T_{es} {}^mC_{es} T_e$ | 1091 | 1110 | 49265 | 49284 | 3237 |

TABLE 62-continued

Modified oligonucleotides complementary to human ATXN2 RNA

| Compound Number | Gapmer motif | Sequence and chemistry notation (5' to 3') | SEQ ID NO: 1 Start Site | SEQ ID NO: 1 Stop Site | SEQ ID NO: 2 Start Site | SEQ ID NO: 2 Stop Site | SEQ ID NO: |
|---|---|---|---|---|---|---|---|
| 1008885 | 5-10-5 | $A_{es} A_{eo} {}^mC_{eo} T_{eo} G_{eo} G_{ds} A_{ds} T_{ds} T_{ds} {}^mC_{ds} T_{ds} G_{ds} T_{ds} A_{ds} {}^mC_{ds} T_{eo} T_{eo} T_{es} T_{es} {}^mC_e$ | 1092 | 1111 | 49266 | 49285 | 3299 |
| 1008886 | 5-10-5 | $G_{es} A_{eo} A_{eo} {}^mC_{eo} T_{eo} G_{ds} G_{ds} A_{ds} T_{ds} T_{ds} {}^mC_{ds} T_{ds} G_{ds} T_{ds} A_{ds} {}^mC_{eo} T_{eo} T_{es} T_{es} T_e$ | 1093 | 1112 | 49267 | 49286 | 3300 |
| 1008887 | 5-10-5 | $T_{es} {}^mC_{eo} {}^mC_{eo} A_{eo} T_{eo} T_{ds} A_{ds} T_{ds} T_{ds} T_{ds} {}^mC_{ds} T_{ds} T_{ds} {}^mC_{ds} A_{ds} {}^mC_{eo} G_{eo} T_{es} T_{es} T_e$ | 1120 | 1139 | 49294 | 49313 | 3301 |
| 1008888 | 5-10-5 | ${}^mC_{es} T_{eo} {}^mC_{eo} {}^mC_{eo} A_{eo} T_{ds} T_{ds} A_{ds} T_{ds} T_{ds} T_{ds} {}^mC_{ds} T_{ds} T_{ds} {}^mC_{ds} A_{eo} {}^mC_{eo} G_{es} T_{es} T_e$ | 1121 | 1140 | 49295 | 49314 | 3238 |
| 1008889 | 5-10-5 | $T_{es} {}^mC_{eo} T_{eo} {}^mC_{eo} {}^mC_{eo} A_{ds} T_{ds} T_{ds} A_{ds} T_{ds} T_{ds} T_{ds} {}^mC_{ds} T_{ds} T_{ds} {}^mC_{ds} A_{eo} {}^mC_{es} G_{es} T_e$ | 1122 | 1141 | 49296 | 49315 | 3239 |
| 1008890 | 5-10-5 | ${}^mC_{es} T_{eo} {}^mC_{eo} T_{eo} A_{eo} T_{ds} T_{ds} T_{ds} {}^mC_{ds} T_{ds} T_{ds} T_{ds} G_{ds} T_{ds} {}^mC_{ds} {}^mC_{eo} A_{eo} G_{es} G_{es} A_e$ | 1647 | 1666 | 83258 | 83277 | 3302 |
| 1008891 | 5-10-5 | $G_{es} T_{eo} G_{eo} G_{eo} T_{eo} G_{ds} T_{ds} G_{ds} {}^mC_{ds} G_{ds} {}^mC_{ds} A_{ds} T_{ds} G_{ds} T_{ds} A_{eo} G_{eo} A_{es} {}^mC_{es} {}^mC_e$ | N/A | N/A | 9001 | 9020 | 3303 |
| 1008892 | 5-10-5 | $G_{es} G_{eo} T_{eo} G_{eo} G_{eo} T_{ds} G_{ds} T_{ds} G_{ds} {}^mC_{ds} G_{ds} {}^mC_{ds} A_{ds} T_{ds} G_{ds} T_{eo} A_{eo} G_{es} A_{es} {}^mC_e$ | N/A | N/A | 9002 | 9021 | 3304 |
| 1008893 | 5-10-5 | $G_{es} T_{eo} G_{eo} G_{eo} T_{eo} G_{ds} G_{ds} T_{ds} G_{ds} T_{ds} G_{ds} {}^mC_{ds} G_{ds} {}^mC_{ds} A_{ds} T_{eo} G_{eo} T_{es} A_{es} G_e$ | N/A | N/A | 9004 | 9023 | 3305 |
| 1008894 | 5-10-5 | ${}^mC_{es} G_{eo} T_{eo} G_{eo} G_{eo} T_{ds} G_{ds} G_{ds} T_{ds} G_{ds} T_{ds} G_{ds} {}^mC_{ds} G_{ds} {}^mC_{ds} A_{eo} T_{eo} G_{es} T_{es} A_e$ | N/A | N/A | 9005 | 9024 | 3306 |
| 1008895 | 5-10-5 | $A_{es} G_{eo} T_{eo} T_{eo} {}^mC_{es} A_{ds} {}^mC_{ds} {}^mC_{ds} T_{ds} G_{ds} {}^mC_{ds} A_{ds} T_{ds} {}^mC_{ds} {}^mC_{ds} {}^mC_{eo} A_{eo} G_{es} G_e G_e$ | 1279 | 1298 | 76416 | 76435 | 3307 |
| 1008896 | 5-10-5 | $G_{es} A_{eo} G_{eo} T_{eo} T_{eo} {}^mC_{ds} A_{ds} {}^mC_{ds} {}^mC_{ds} T_{ds} G_{ds} {}^mC_{ds} A_{ds} T_{ds} {}^mC_{ds} {}^mC_{eo} {}^mC_{eo} A_{es} G_{es} G_e$ | 1280 | 1299 | 76417 | 76436 | 3308 |
| 1008897 | 5-10-5 | $T_{es} G_{eo} A_{eo} G_{eo} T_{eo} T_{ds} {}^mC_{ds} A_{ds} {}^mC_{ds} {}^mC_{ds} T_{ds} G_{ds} {}^mC_{ds} A_{ds} T_{ds} {}^mC_{eo} {}^mC_{eo} {}^mC_{es} A_{es} G_e$ | 1281 | 1300 | 76418 | 76437 | 3309 |
| 1008898 | 5-10-5 | $T_{es} G_{eo} T_{eo} G_{eo} A_{eo} G_{ds} T_{ds} T_{ds} {}^mC_{ds} A_{ds} {}^mC_{ds} {}^mC_{ds} T_{ds} G_{ds} {}^mC_{ds} A_{eo} T_{eo} {}^mC_{es} {}^mC_{es} {}^mC_e$ | 1283 | 1302 | 76420 | 76439 | 3310 |
| 1008899 | 5-10-5 | ${}^mC_{es} T_{eo} G_{eo} T_{eo} G_{eo} A_{ds} G_{ds} T_{ds} T_{ds} {}^mC_{ds} A_{ds} {}^mC_{ds} {}^mC_{ds} T_{ds} G_{ds} {}^mC_{eo} A_{eo} T_{es} {}^mC_{es} {}^mC_e$ | 1284 | 1303 | 76421 | 76440 | 3311 |
| 1008900 | 5-10-5 | $G_{es} {}^mC_{eo} T_{eo} G_{eo} T_{eo} G_{ds} A_{ds} G_{ds} T_{ds} T_{ds} {}^mC_{ds} A_{ds} {}^mC_{ds} {}^mC_{ds} T_{ds} G_{eo} {}^mC_{eo} A_{es} T_{es} {}^mC_e$ | 1285 | 1304 | 76422 | 76441 | 3312 |
| 1008901 | 5-10-5 | $G_{es} {}^mC_{eo} G_{eo} G_{eo} T_{eo} G_{ds} A_{ds} A_{ds} T_{ds} T_{ds} {}^mC_{ds} T_{ds} G_{ds} T_{ds} {}^mC_{ds} T_{eo} {}^mC_{eo} {}^mC_{es} {}^mC_{es} A_e$ | 1686 | 1705 | 83297 | 83316 | 3313 |
| 1008902 | 5-10-5 | $T_{es} A_{eo} {}^mC_{eo} G_{eo} {}^mC_{eo} G_{ds} G_{ds} T_{ds} G_{ds} A_{ds} A_{ds} T_{ds} T_{ds} {}^mC_{ds} T_{ds} G_{eo} T_{eo} {}^mC_{es} T_{es} {}^mC_e$ | 1689 | 1708 | 83300 | 83319 | 3314 |
| 1008903 | 5-10-5 | ${}^mC_{es} A_{eo} T_{eo} A_{eo} {}^mC_{eo} G_{ds} {}^mC_{ds} G_{ds} G_{ds} T_{ds} G_{ds} A_{ds} A_{ds} T_{ds} T_{ds} {}^mC_{eo} T_{eo} G_{es} T_{es} {}^mC_e$ | 1691 | 1710 | 83302 | 83321 | 3315 |
| 1008904 | 5-10-5 | $A_{es} {}^mC_{eo} T_{eo} G_{eo} T_{eo} T_{ds} T_{ds} {}^mC_{ds} G_{ds} A_{ds} {}^mC_{ds} {}^mC_{ds} T_{ds} {}^mC_{ds} T_{ds} G_{eo} A_{eo} A_{es} A_{es} A_e$ | N/A | N/A | 45741 | 45760 | 3316 |
| 1008905 | 5-10-5 | $T_{es} A_{eo} {}^mC_{eo} T_{eo} G_{eo} T_{ds} T_{ds} T_{ds} {}^mC_{ds} G_{ds} A_{ds} {}^mC_{ds} {}^mC_{ds} T_{ds} {}^mC_{ds} T_{eo} G_{eo} A_{es} A_{es} A_e$ | N/A | N/A | 45742 | 45761 | 3317 |
| 1008906 | 5-10-5 | $T_{es} T_{eo} A_{eo} {}^mC_{eo} T_{eo} G_{ds} T_{ds} T_{ds} T_{ds} {}^mC_{ds} G_{ds} A_{ds} {}^mC_{ds} {}^mC_{ds} T_{ds} {}^mC_{eo} T_{eo} G_{es} A_{es} A_e$ | N/A | N/A | 45743 | 45762 | 3318 |
| 1008907 | 5-10-5 | $T_{es} G_{eo} T_{eo} T_{eo} A_{eo} {}^mC_{ds} T_{ds} G_{ds} T_{ds} T_{ds} T_{ds} {}^mC_{ds} G_{ds} A_{ds} {}^mC_{ds} {}^mC_{eo} T_{eo} {}^mC_{es} T_{es} G_e$ | 891 | 910 | 45745 | 45764 | 3319 |
| 1008908 | 5-10-5 | $T_{es} G_{eo} T_{eo} A_{eo} {}^mC_{es} T_{ds} T_{ds} {}^mC_{ds} A_{ds} {}^mC_{ds} A_{ds} T_{ds} T_{ds} T_{ds} G_{ds} G_{eo} A_{eo} G_{es} {}^mC_{es} {}^mC_e$ | 991 | 1010 | 48690 | 48709 | 1185 |
| 1008909 | 5-10-5 | $T_{es} G_{eo} T_{eo} A_{es} {}^mC_{es} T_{ds} T_{ds} {}^mC_{ds} A_{ds} {}^mC_{ds} A_{ds} T_{ds} T_{ds} T_{ds} G_{ds} G_{eo} A_{eo} G_{es} {}^mC_{es} {}^mC_e$ | 991 | 1010 | 48690 | 48709 | 1185 |
| 1008910 | 5-10-5 | $T_{es} {}^mC_{eo} T_{eo} G_{eo} T_{es} A_{ds} {}^mC_{ds} T_{ds} T_{ds} T_{ds} T_{ds} {}^mC_{ds} T_{ds} {}^mC_{ds} A_{ds} T_{eo} G_{eo} T_{es} G_{es} {}^mC_e$ | 1084 | 1103 | 49258 | 49277 | 2544 |
| 1008911 | 5-10-5 | $T_{es} {}^mC_{eo} T_{eo} G_{es} T_{es} A_{ds} {}^mC_{ds} T_{ds} T_{ds} T_{ds} T_{ds} {}^mC_{ds} T_{ds} {}^mC_{ds} A_{ds} T_{eo} G_{eo} T_{es} G_{es} {}^mC_e$ | 1084 | 1103 | 49258 | 49277 | 2544 |
| 1008912 | 5-10-5 | ${}^mC_{es} A_{eo} {}^mC_{eo} A_{eo} G_{es} T_{ds} T_{ds} T_{ds} {}^mC_{ds} A_{ds} {}^mC_{ds} T_{ds} A_{ds} G_{ds} G_{ds} T_{eo} T_{eo} {}^mC_{es} T_{es} {}^mC_e$ | N/A | N/A | 57471 | 57490 | 2121 |
| 1008913 | 5-10-5 | ${}^mC_{es} A_{eo} {}^mC_{eo} A_{es} G_{es} T_{ds} T_{ds} T_{ds} {}^mC_{ds} A_{ds} {}^mC_{ds} T_{ds} A_{ds} G_{ds} G_{ds} T_{eo} T_{eo} {}^mC_{es} T_{es} {}^mC_e$ | N/A | N/A | 57471 | 57490 | 2121 |
| 1008914 | 5-10-5 | $A_{es} {}^mC_{eo} A_{eo} {}^mC_{eo} A_{es} G_{ds} T_{ds} T_{ds} T_{ds} {}^mC_{ds} A_{ds} {}^mC_{ds} T_{ds} A_{ds} G_{ds} G_{eo} T_{eo} T_{es} {}^mC_{es} T_e$ | N/A | N/A | 57472 | 57491 | 2503 |
| 1008915 | 5-10-5 | $A_{es} {}^mC_{eo} A_{eo} {}^mC_{es} A_{es} G_{ds} T_{ds} T_{ds} T_{ds} {}^mC_{ds} A_{ds} {}^mC_{ds} T_{ds} A_{ds} G_{ds} G_{eo} T_{eo} T_{es} {}^mC_{es} T_e$ | N/A | N/A | 57472 | 57491 | 2503 |
| 1008916 | 5-10-5 | $T_{es} T_{eo} {}^mC_{eo} T_{eo} {}^mC_{es} T_{ds} A_{ds} T_{ds} T_{ds} T_{ds} {}^mC_{ds} T_{ds} T_{ds} T_{ds} G_{ds} T_{eo} {}^mC_{eo} {}^mC_{es} A_{es} G_e$ | 1649 | 1668 | 83260 | 83279 | 804 |
| 1008917 | 5-10-5 | $T_{es} T_{eo} {}^mC_{eo} T_{es} {}^mC_{es} T_{ds} A_{ds} T_{ds} T_{ds} T_{ds} {}^mC_{ds} T_{ds} T_{ds} T_{ds} G_{ds} T_{eo} {}^mC_{eo} {}^mC_{es} A_{es} G_e$ | 1649 | 1668 | 83260 | 83279 | 804 |

Example 8: Effect of MOE Gapmers with Mixed Internucleoside Linkages on Human ATXN2 In Vitro, Multiple Doses Modified oligonucleotides selected from the examples above were tested at various doses in A431 cells. Cells were plated at a density of 11,000 cells per well and transfected by free uptake with 0.023, 0.094, 0.375, 1.500 or 6.000 µM concentrations of modified oligonucleotide, as specified in the tables below. After a treatment period of approximately 48 hours, total RNA was isolated from the cells and ATXN2 RNA levels were measured by quantitative real-time PCR Human ATXN2 primer probe set RTS5051 (forward sequence TCCAGTAGCAAGGACCAGT, designated herein as SEQ ID NO: 16; reverse sequence CAATACTGTTCTGTCTGGGAGA, designated herein as SEQ ID NO: 17; probe sequence ACTGACCACT-GATGACCACGTTCC, designated herein as SEQ ID: 18) was used to measure RNA levels. ATXN2 RNA levels were adjusted according to total RNA content, as measured by RIBOGREEN®. Results are presented in the tables below as percent ATXN2 RNA expression relative to untreated control cells. As illustrated in the tables below, ATXN2 RNA levels were reduced in a dose-dependent manner in modified oligonucleotide-treated cells. $IC_{50}$ was calculated using the "log(inhibitor) vs. response–variable slope (4 parameters)" formula u sing Prism6 software.

TABLE 63

Dose-dependent reduction of human ATXN2 RNA expression in A431 cells

| Compound Number | ATXN2 expression (% control) | | | | | $IC_{50}$ (µM) |
|---|---|---|---|---|---|---|
| | 0.023 µM | 0.094 µM | 0.375 µM | 1.500 µM | 6.000 µM | |
| 756993 | 88 | 83 | 59 | 37 | 22 | 0.8 |
| 874218 | 99 | 83 | 56 | 37 | 22 | 0.7 |
| 1008800 | 99 | 86 | 57 | 34 | 22 | 0.7 |
| 1008806 | 90 | 84 | 67 | 41 | 32 | 1.2 |
| 1008845 | 94 | 74 | 54 | 32 | 24 | 0.6 |
| 1008852 | 90 | 70 | 39 | 19 | 10 | 0.3 |
| 1008854 | 97 | 83 | 71 | 54 | 43 | 2.7 |
| 1008862 | 105 | 82 | 79 | 40 | 29 | 1.3 |
| 1008865 | 95 | 56 | 36 | 17 | 8 | 0.2 |
| 1008870 | 95 | 73 | 46 | 24 | 14 | 0.4 |
| 1008871 | 95 | 83 | 63 | 40 | 26 | 0.9 |
| 1008872 | 90 | 78 | 69 | 49 | 36 | 1.6 |
| 1008874 | 94 | 78 | 54 | 36 | 26 | 0.7 |
| 1008875 | 83 | 69 | 40 | 24 | 13 | 0.3 |
| 1008881 | 91 | 71 | 61 | 57 | 43 | 2.4 |

TABLE 63-continued

Dose-dependent reduction of human ATXN2 RNA expression in A431 cells

| Compound Number | ATXN2 expression (% control) | | | | | $IC_{50}$ (µM) |
|---|---|---|---|---|---|---|
| | 0.023 µM | 0.094 µM | 0.375 µM | 1.500 µM | 6.000 µM | |
| 1008884 | 86 | 116 | 40 | 22 | 14 | 0.3 |
| 1008888 | 84 | 62 | 39 | 20 | 12 | 0.2 |
| 1008889 | 84 | 60 | 31 | 18 | 10 | 0.2 |
| 1008910 | 90 | 77 | 49 | 23 | 14 | 0.4 |

Example 9: Effect of Modified Oligonucleotides on Human ATXN2 In Vitro, Multiple Doses Modified oligonucleotides selected from the examples above were tested at various doses in SH-SY5Y cells. Cells were plated at a density of 35,000 cells per well and transfected by free uptake with 0.023, 0.094, 0.375, 1.500, or 6.000 µM concentrations of modified oligonucleotide, as specified in the tables below. After a treatment period of approximately 24 hours, total RNA was isolated from the cells and ATXN2 RNA levels were measured by quantitative real-time PCR Human ATXN2 primer probe set RTS5051 (described herein in Example 8) was used to measure RNA levels. ATXN2 RNA levels were adjusted according to total RNA content, as measured by RIBOGREEN®. Results are presented in the tables below as percent ATXN2 RNA relative to untreated control. As illustrated in the tables below, ATXN2 RNA levels were reduced in a dose-dependent manner in modified oligonucleotide-treated cells. $IC_{50}$ was calculated using the "log(inhibitor) vs. response–variable slope (4 parameters)" formula u sing Prism6 software.

TABLE 64

Dose-dependent reduction of human ATXN2 RNA expression in SH-SY5Y cells

| Compound Number | ATXN2 expression (% control) | | | | | $IC_{50}$ (µM) |
|---|---|---|---|---|---|---|
| | 0.023 µM | 0.094 µM | 0.375 µM | 1.500 µM | 6.000 µM | |
| 756993 | 131 | 98 | 73 | 37 | 15 | 1.0 |
| 874218 | 111 | 89 | 62 | 26 | 15 | 0.7 |
| 1008800 | 96 | 89 | 64 | 45 | 19 | 1.0 |
| 1008806 | 102 | 99 | 74 | 55 | 34 | 2.1 |
| 1008854 | 90 | 86 | 75 | 56 | 31 | 1.9 |
| 1008862 | 114 | 107 | 78 | 50 | 21 | 1.5 |

TABLE 65

Dose-dependent reduction of human ATXN2 RNA expression in SH-SY5Y cells

| Compound Number | ATXN2 expression (% control) | | | | | $IC_{50}$ (µM) |
|---|---|---|---|---|---|---|
| | 0.023 µM | 0.094 µM | 0.375 µM | 1.500 µM | 6.000 µM | |
| 1008865 | 108 | 97 | 74 | 35 | 16 | 1.0 |
| 1008870 | 109 | 99 | 90 | 52 | 24 | 1.7 |
| 1008874 | 98 | 90 | 75 | 42 | 27 | 1.3 |

TABLE 65-continued

Dose-dependent reduction of human ATXN2 RNA expression in SH-SY5Y cells

| Compound Number | ATXN2 expression (% control) | | | | | $IC_{50}$ ($\mu M$) |
|---|---|---|---|---|---|---|
| | 0.023 $\mu M$ | 0.094 $\mu M$ | 0.375 $\mu M$ | 1.500 $\mu M$ | 6.000 $\mu M$ | |
| 1008888 | 100 | 95 | 72 | 43 | 30 | 1.4 |
| 1008889 | 91 | 86 | 58 | 36 | 15 | 0.7 |
| 1008910 | 106 | 106 | 85 | 50 | 23 | 1.6 |

Example 10: Effect of Modified Oligonucleotides on Rhesus Monkey ATXN2 RNA Expression In Vitro, Multiple Doses Modified oligonucleotides selected from the examples above, which are also complementary to rhesus monkey ATXN2, were tested at various doses in LLC-MK2 monkey cells. Cells were plated at a density of 20,000 cells per well and transfected by free uptake with 0.023, 0.094, 0.375, 1.500, or 6.000 μM concentrations of modified oligonucleotide, as specified in the tables below. After a treatment period of approximately 24 hours, total RNA was isolated from the cells and ATXN2 RNA levels were measured by quantitative real-time PCR Human ATXN2 primer probe set RTS5051 (described herein in Example 8) was used to measure RNA levels. ATXN2 RNA levels were adjusted according to total RNA content, as measured by RIBOGREEN®. Results are presented in the tables below as percent ATXN2 RNA expression relative to untreated control cells. As illustrated in the tables below, ATXN2 RNA levels were reduced in a dose-dependent manner in modified oligonucleotide-treated cells. $IC_{50}$ was calculated using the "log(inhibitor) vs. response–variable slope (4 parameters)" formula u sing Prism6 software.

TABLE 66

Dose-dependent reduction of human ATXN2 RNA expression in LLC-MK2 rhesus monkey cells

| Compound Number | ATXN2 expression (% control) | | | | | $IC_{50}$ ($\mu M$) |
|---|---|---|---|---|---|---|
| | 0.023 $\mu M$ | 0.094 $\mu M$ | 0.375 $\mu M$ | 1.500 $\mu M$ | 6.000 $\mu M$ | |
| 756993* | 140 | 124 | 107 | 69 | 26 | 2.8 |
| 874218* | 114 | 97 | 83 | 50 | 21 | 1.5 |
| 1008800 | 106 | 108 | 85 | 57 | 31 | 2.2 |
| 1008806 | 102 | 103 | 97 | 84 | 50 | 7.3 |
| 1008854 | 87 | 88 | 78 | 59 | 34 | 2.3 |
| 1008862 | 97 | 99 | 87 | 58 | 29 | 2.2 |

*Oligos contain one mismatch to rhesus monkey

TABLE 67

Dose-dependent reduction of human ATXN2 RNA expression in LLC-MK2 rhesus monkey cells

| Compound Number | ATXN2 expression (% control) | | | | | $IC_{50}$ ($\mu M$) |
|---|---|---|---|---|---|---|
| | 0.023 $\mu M$ | 0.094 $\mu M$ | 0.375 $\mu M$ | 1.500 $\mu M$ | 6.000 $\mu M$ | |
| 1008865 | 114 | 105 | 101 | 56 | 22 | 2.1 |
| 1008870 | 107 | 87 | 76 | 58 | 26 | 1.7 |
| 1008874 | 90 | 82 | 66 | 39 | 18 | 0.7 |
| 1008888 | 91 | 85 | 82 | 53 | 24 | 1.7 |
| 1008889 | 75 | 78 | 68 | 36 | 15 | 0.9 |
| 1008910 | 86 | 94 | 79 | 72 | 31 | 2.7 |

Example 11: Design of 5-8-5 MOE Gapmers with Mixed Internucleoside Linkages Complementary to Human ATXN2 RNA Modified oligonucleotides complementary to a human ATXN2 nucleic acid were designed. The modified oligonucleotides in the table below are 5-8-5 MOE gapmers. The gapmers are 18 nucleobases in length, wherein the central gap segment comprises eight 2'-deoxynucleosides and is flanked by wing segments on both the 5' end and on the 3' end comprising five 2'-MOE nucleosides. The sugar motif for the gapmers is (from 5' to 3'): eeeeedddddddeeeee; wherein 'd' represents a 2'-deoxyribose sugar and 'e' represents a 2'-MOE modified sugar. The internucleoside linkages are mixed phosphodiester and phosphorothioate linkages. The internucleoside linkage motif for the gapmers is (from 5' to 3'): sooosssssssssooss; wherein 'o' represents a phosphodiester internucleoside linkage and 's' represents a phosphorothioate internucleoside linkage. Each cytosine residue is a 5-methyl cytosine. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in the table below is complementary to human ATXN2 nucleic acid sequence SEQ ID NO: 1 or SEQ ID NO: 2, as indicated. 'N/A' indicates that the modified oligonucleotide is not complementary to that particular nucleic acid with 100% complementarity.

TABLE 68

5-8-5 MOE gapmers with mixed internucleoside linkages complementary to human ATXN2 RNA

| Compound Number | Sequence (5' to 3') | SEQ ID NO: 1 Start Site | SEQ ID NO: 1 Stop Site | SEQ ID NO: 2 Start Site | SEQ ID NO: 2 Stop Site | SEQ ID NO: |
|---|---|---|---|---|---|---|
| 1008786 | TTAGAGTTTTTGCCTTCC | N/A | N/A | 9932 | 9949 | 3240 |
| 1008787 | CTTAGAGTTTTTGCCTTC | N/A | N/A | 9933 | 9950 | 3241 |
| 1008788 | GCTTAGAGTTTTTGCCTT | N/A | N/A | 9934 | 9951 | 3242 |
| 1008789 | TATGTTTGTCTGTCTTAT | N/A | N/A | 33816 | 33833 | 3243 |
| 1008790 | GTATGTTTGTCTGTCTTA | N/A | N/A | 33817 | 33834 | 3244 |
| 1008791 | CGTATGTTTGTCTGTCTT | N/A | N/A | 33818 | 33835 | 3245 |
| 1008792 | TACTTCACATTTGGAGCC | 991 | 1008 | 48690 | 48707 | 3246 |
| 1008793 | GTACTTCACATTTGGAGC | 992 | 1009 | 48691 | 48708 | 3247 |
| 1008794 | TGTACTTCACATTTGGAG | 993 | 1010 | 48692 | 48709 | 3248 |
| 1008795 | TTTTCTCATGTGCGGCAT | 1079 | 1096 | 49253 | 49270 | 3249 |
| 1008796 | CTTTTCTCATGTGCGGCA | 1080 | 1097 | 49254 | 49271 | 3250 |
| 1008797 | ACTTTTCTCATGTGCGGC | 1081 | 1098 | 49255 | 49272 | 3251 |
| 1008798 | TACTTTTCTCATGTGCGG | 1082 | 1099 | 49256 | 49273 | 3252 |
| 1008799 | GTACTTTTCTCATGTGCG | 1083 | 1100 | 49257 | 49274 | 3253 |
| 1008801 | CTGTACTTTTCTCATGTG | 1085 | 1102 | 49259 | 49276 | 3254 |
| 1008802 | TCTGTACTTTTCTCATGT | 1086 | 1103 | 49260 | 49277 | 3255 |
| 1008803 | TTCTGTACTTTTCTCATG | 1087 | 1104 | 49261 | 49278 | 3256 |
| 1008804 | ATTCTGTACTTTTCTCAT | 1088 | 1105 | 49262 | 49279 | 3257 |
| 1008805 | GATTCTGTACTTTTCTCA | 1089 | 1106 | 49263 | 49280 | 3258 |
| 1008807 | TGGATTCTGTACTTTTCT | 1091 | 1108 | 49265 | 49282 | 3259 |
| 1008808 | CTGGATTCTGTACTTTTC | 1092 | 1109 | 49266 | 49283 | 3260 |
| 1008809 | CTCCATTATTTCTTCACG | 1123 | 1140 | 49297 | 49314 | 3261 |
| 1008810 | TCTCCATTATTTCTTCAC | 1124 | 1141 | 49298 | 49315 | 3262 |
| 1008811 | CTCTCCATTATTTCTTCA | 1125 | 1142 | 49299 | 49316 | 3263 |
| 1008812 | TAACTGGTTTGCCCTTGC | 1477 | 1494 | 81637 | 81654 | 3264 |
| 1008813 | CTAACTGGTTTGCCCTTG | 1478 | 1495 | 81638 | 81655 | 3265 |

TABLE 68-continued 5-8-5 MOE gapmers with mixed internucleoside linkages complementary to human ATXN2 RNA

| Compound Number | Sequence (5' to 3') | SEQ ID NO: 1 Start Site | SEQ ID NO: 1 Stop Site | SEQ ID NO: 2 Start Site | SEQ ID NO: 2 Stop Site | SEQ ID NO: |
|---|---|---|---|---|---|---|
| 1008814 | GCTAACTGGTTTGCCCTT | 1479 | 1496 | 81639 | 81656 | 3266 |
| 1008815 | TGCTAACTGGTTTGCCCT | 1480 | 1497 | 81640 | 81657 | 3267 |
| 1008816 | CTGCTAACTGGTTTGCCC | 1481 | 1498 | 81641 | 81658 | 3268 |
| 1008817 | TCTGCTAACTGGTTTGCC | 1482 | 1499 | 81642 | 81659 | 3269 |
| 1008818 | TTCTGCTAACTGGTTTGC | 1483 | 1500 | 81643 | 81660 | 3270 |
| 1008819 | TCATCATTTTCCAGGGCC | 1536 | 1553 | 81696 | 81713 | 3271 |
| 1008820 | ATCATCATTTTCCAGGGC | 1537 | 1554 | 81697 | 81714 | 3272 |
| 1008821 | TATCATCATTTTCCAGGG | 1538 | 1555 | 81698 | 81715 | 3273 |
| 1008822 | CTATCATCATTTTCCAGG | 1539 | 1556 | 81699 | 81716 | 3274 |
| 1008823 | CCTATCATCATTTTCCAG | 1540 | 1557 | 81700 | 81717 | 3275 |
| 1008824 | TCCTATCATCATTTTCCA | 1541 | 1558 | 81701 | 81718 | 3276 |
| 1008825 | CTCCTATCATCATTTTCC | 1542 | 1559 | 81702 | 81719 | 3277 |
| 1008826 | CTATTTCTTTGTCCAGGA | 1647 | 1664 | 83258 | 83275 | 3278 |
| 1008827 | TCTATTTCTTTGTCCAGG | 1648 | 1665 | 83259 | 83276 | 3279 |
| 1008828 | CTCTATTTCTTTGTCCAG | 1649 | 1666 | 83260 | 83277 | 3280 |
| 1008829 | TCTCTATTTCTTTGTCCA | 1650 | 1667 | 83261 | 83278 | 3281 |
| 1008830 | TTCTCTATTTCTTTGTCC | 1651 | 1668 | 83262 | 83279 | 3282 |
| 1008831 | CTTCTCTATTTCTTTGTC | 1652 | 1669 | 83263 | 83280 | 3283 |
| 1008832 | ACTTCTCTATTTCTTTGT | 1653 | 1670 | 83264 | 83281 | 3284 |
| 1008833 | GTGGTGTGCGCATGTAGA | N/A | N/A | 9003 | 9020 | 3285 |
| 1008834 | GGTGGTGTGCGCATGTAG | N/A | N/A | 9004 | 9021 | 3286 |
| 1008835 | TGGTGGTGTGCGCATGTA | N/A | N/A | 9005 | 9022 | 3287 |
| 1008836 | TACTGTTTCGACCTCTGA | N/A | N/A | 45744 | 45761 | 3288 |
| 1008837 | TTACTGTTTCGACCTCTG | 891 | 908 | 45745 | 45762 | 3289 |
| 1008838 | GTTACTGTTTCGACCTCT | 892 | 909 | 45746 | 45763 | 3290 |

Example 12: Design of 4-10-6 MOE Gapmers with Mixed Internucleoside Linkages Complementary to Human ATXN2 RNA Modified oligonucleotides complementary to a human ATXN2 nucleic acid were designed. The modified oligonucleotides in the table below are 4-10-6 MOE gapmers. The gapmers are 20 nucleobases in length, wherein the central gap segment comprises eight 2'-deoxynucleosides and is flanked by wing segments on both the 5' end and on the 3' end comprising five 2'-MOE nucleosides. The sugar motif for the gapmers is (from 5' to 3'): eeeeddddddddd-deeeeee; wherein 'd' represents a 2'-deoxyribose sugar and 'e' represents a 2'-MOE modified sugar. The internucleoside linkages are mixed phosphodiester and phosphorothioate linkages. The internucleoside linkage motif for the gapmers is (from 5' to 3'): sooosssssssssssooss; wherein 'o' represents a phosphodiester internucleoside linkage and 's' represents a phosphorothioate internucleoside linkage. Each cytosine residue is a 5-methyl cytosine. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in the table below is complementary to human ATXN2 nucleic acid sequence SEQ ID NO: 1 or SEQ ID NO: 2, as indicated. 'N/A' indicates that the modified oligonucleotide is not complementary to that particular nucleic acid with 100% complementarity.

TABLE 69

4-10-6 MOE gapmers with mixed internucleoside linkages complementary to human ATXN2 RNA

| Compound Number | Sequence (5' to 3') | SEQ ID NO: 1 Start Site | SEQ ID NO: 1 Stop Site | SEQ ID NO: 2 Start Site | SEQ ID NO: 2 Stop Site | SEQ ID NO: |
|---|---|---|---|---|---|---|
| 1008839 | CTTAGAGTTTTTGCCTTCCA | N/A | N/A | 9931 | 9950 | 3087 |
| 1008840 | GCTTAGAGTTTTTGCCTTCC | N/A | N/A | 9932 | 9951 | 2177 |
| 1008841 | AGCTTAGAGTTTTTGCCTTC | N/A | N/A | 9933 | 9952 | 3164 |
| 1008842 | CGTATGTTTGTCTGTCTTAT | N/A | N/A | 33816 | 33835 | 2262 |
| 1008843 | TGTACTTCACATTTGGAGCC | 991 | 1010 | 48690 | 48709 | 1185 |
| 1008844 | ACTTTTCTCATGTGCGGCAT | 1079 | 1098 | 49253 | 49272 | 1561 |
| 1008846 | TCTGTACTTTCTCATGTGC | 1084 | 1103 | 49258 | 49277 | 2544 |
| 1008847 | TTCTCTATTTCTTTGTCCAG | 1649 | 1668 | 83260 | 83279 | 804 |
| 1008848 | ACACAGTTTCACTAGGTTCT | N/A | N/A | 57472 | 57491 | 2503 |
| 1008849 | TGGTGGTGTGCGCATGTAGA | N/A | N/A | 9003 | 9022 | 1800 |
| 1008850 | GTTACTGTTTCGACCTCTGA | N/A | N/A | 45744 | 45763 | 3291 |
| 1008851 | TGGATTCTGTACTTTTCTCA | 1089 | 1108 | 49263 | 49282 | 3235 |
| 1008853 | CTCTCCATTATTTCTTCACG | 1123 | 1142 | 49297 | 49316 | 33 |
| 1008855 | CCTATCATCATTTTCCAGGG | 1538 | 1557 | 81698 | 81717 | 158 |
| 1008856 | ACTTCTCTATTTCTTTGTCC | 1651 | 1670 | 83262 | 83281 | 172 |
| 1008857 | GTGATGTTTCATTGGGTTTA | 2460 | 2479 | 91730 | 91749 | 1188 |

Example 13: Tolerability of Modified Oligonucleotides Complementary to Human ATXN2 RNA in Wild-Type Mice, 3 Hour FOB Assessment Modified oligonucleotides described above were tested in wild-type mice to assess the tolerability of the oligonucleotides. Comparator oligonucleotides 564122, 564127, 564133, 564143, 564150, 564188, 564210, 564216, described hereinabove and in WO 2015/143246, were also tested. Wild type C57/B16 mice each received a single ICV dose of 700 µg of modified oligonucleotide listed in the table below. Each treatment group consisted of 4 mice. A group of 3 mice received PBS as a negative control for each experiment (identified in separate tables below). At 3 hours post-injection, mice were evaluated according to 7 different criteria. The criteria are (1) the mouse was bright, alert, and responsive; (2) the mouse was standing or hunched without stimuli; (3) the mouse showed any movement without stimuli; (4) the mouse demonstrated forward movement after it was lifted; (5) the mouse demonstrated any movement after it was lifted; (6) the mouse responded to tail pinching; (7) regular breathing. For each of the 7 criteria, a mouse was given a subscore of 0 if it met the criteria and 1 if it did not (the functional observational battery score or FOB). After all 7 criteria were evaluated, the scores were summed for each mouse and averaged within each treatment group. Results are presented as the average score for each treatment group in the tables below.

TABLE 70

Tolerability scores in wild-type mice

| Compound Number | 3 hr FOB |
|---|---|
| 564122 | 7.00 |
| 564127 | 7.00 |
| 564133 | 7.00 |
| 564143 | 7.00 |
| 564150 | 7.00 |
| 564188 | 7.00 |
| 564210 | 7.00 |
| 564216 | 7.00 |

TABLE 71

Tolerability scores in wild-type mice

| Compound Number | 3 hr FOB |
|---|---|
| 708151 | 0 |
| 757066 | 3.00 |
| 760782 | 6.00 |
| 708154 | 5.25 |
| 757052 | 5.50 |
| 755233 | 4.00 |
| 702063 | 5.75 |
| 755235 | 5.25 |
| 756978 | 3.75 |
| 757130 | 4.00 |
| 757162 | 6.00 |
| 757089 | 3.75 |
| 757210 | 6.25 |
| 760771 | 4.00 |

TABLE 71-continued

Tolerability scores in wild-type mice

| Compound Number | 3 hr FOB |
|---|---|
| 708199 | 6.75 |
| 757055 | 3.25 |
| 757234 | 6.00 |

TABLE 72

Tolerability scores in wild-type mice

| Compound Number | 3 hr FOB |
|---|---|
| 874211 | 2.00 |
| 874251 | 3.00 |
| 874216 | 5.00 |
| 874217 | 3.75 |
| 874280 | 4.50 |
| 874249 | 6.50 |
| 874282 | 4.50 |
| 874212 | 2.25 |
| 874279 | 6.25 |
| 874288 | 6.00 |
| 874281 | 4.50 |
| 874327 | 5.00 |
| 874388 | 1.00 |
| 874384 | 4.50 |
| 874246 | 0.25 |
| 874247 | 0 |
| 874250 | 6.75 |
| 874277 | 7.00 |
| 874283 | 7.00 |
| 874334 | 5.00 |
| 874335 | 6.25 |
| 874385 | 4.50 |

TABLE 73

Tolerability scores in wild-type mice

| Compound Number | 3 hr FOB |
|---|---|
| 874771 | 6.25 |
| 874754 | 0 |
| 874702 | 1.00 |
| 874745 | 2.50 |
| 874748 | 5.25 |
| 874752 | 3.00 |
| 874753 | 2.00 |
| 874501 | 0 |
| 874503 | 6.00 |
| 874669 | 0 |
| 874706 | 5.00 |
| 874738 | 5.25 |
| 874782 | 5.00 |

TABLE 74

Tolerability scores in wild-type mice

| Compound Number | 3 hr FOB |
|---|---|
| 874785 | 2.00 |
| 874842 | 6.25 |
| 875389 | 4.50 |
| 875148 | 3.00 |
| 874939 | 5.25 |
| 875032 | 3.25 |
| 875328 | 6.50 |
| 875319 | 2.25 |
| 875341 | 2.25 |
| 875252 | 0 |

TABLE 74-continued

Tolerability scores in wild-type mice

| Compound Number | 3 hr FOB |
|---|---|
| 874969 | 6.00 |
| 875346 | 1.00 |
| 875347 | 0 |
| 874792 | 2.75 |
| 875360 | 2.50 |
| 874874 | 7.00 |
| 874903 | 5.00 |
| 874937 | 0 |
| 875063 | 3.50 |
| 875315 | 5.50 |

TABLE 75

Tolerability scores in wild-type mice

| Compound Number | 3 hr FOB |
|---|---|
| 875485 | 3.50 |
| 875680 | 6.00 |
| 875650 | 3.75 |
| 875804 | 2.00 |
| 875764 | 4.00 |
| 875427 | 6.25 |
| 875966 | 0 |
| 875803 | 2.25 |
| 875477 | 4.00 |
| 875799 | 4.00 |
| 875807 | 3.00 |
| 875822 | 4.00 |
| 875398 | 6.50 |
| 875452 | 2.50 |

TABLE 76

Tolerability scores in wild-type mice

| Compound Number | 3 hr FOB |
|---|---|
| 937471 | 4.00 |
| 937481 | 3.00 |
| 937480 | 1.00 |
| 937508 | 4.00 |
| 937468 | 3.00 |
| 937467 | 1.00 |
| 937456 | 0.75 |
| 937509 | 2.00 |
| 937383 | 2.00 |
| 937385 | 3.50 |
| 937424 | 6.00 |
| 937422 | 6.50 |
| 937478 | 6.00 |
| 937423 | 6.25 |
| 937437 | 0.25 |
| 937477 | 6.00 |
| 937436 | 0 |
| 937421 | 5.50 |
| 937465 | 3.75 |
| 937469 | 2.50 |
| 937470 | 3.50 |
| 937365 | 0 |

TABLE 77

Tolerability scores in wild-type mice

| Compound Number | 3 hr FOB |
|---|---|
| 937680 | 4.00 |
| 937639 | 0 |

TABLE 77-continued

Tolerability scores in wild-type mice

| Compound Number | 3 hr FOB |
|---|---|
| 937794 | 3.00 |
| 937792 | 0 |
| 937547 | 0 |
| 937739 | 3.75 |
| 937633 | 2.00 |
| 937754 | 4.00 |
| 937620 | 3.00 |
| 937611 | 0 |
| 937725 | 0 |
| 937795 | 4.75 |
| 937579 | 1.00 |
| 937591 | 6.00 |
| 937510 | 0 |
| 937572 | 0 |
| 937511 | 1.00 |
| 937738 | 3.00 |
| 937593 | 3.75 |
| 937592 | 4.50 |
| 937748 | 4.50 |
| 937578 | 0 |
| 937618 | 0 |
| 937619 | 0 |

TABLE 78

Tolerability scores in wild-type mice

| Compound Number | 3 hr FOB |
|---|---|
| 937936 | 4.00 |
| 937939 | 4.00 |
| 937989 | 0 |
| 937938 | 6.00 |
| 937934 | 1.00 |
| 938163 | 0 |
| 937796 | 0 |
| 937987 | 3.00 |
| 938004 | 1.00 |
| 937991 | 0 |
| 938174 | 0 |
| 938173 | 0 |
| 938237 | 4.00 |
| 937983 | 0 |
| 937940 | 6.50 |
| 937942 | 5.00 |
| 937972 | 2.50 |
| 938170 | 0 |
| 938172 | 0 |
| 938221 | 0 |
| 937973 | 4.50 |
| 938043 | 1.00 |
| 938136 | 3.00 |
| 938210 | 2.00 |

TABLE 79

Tolerability scores in wild-type mice

| Compound Number | 3 hr FOB |
|---|---|
| 874430 | 4.50 |
| 874554 | 4.00 |
| 874639 | 4.00 |
| 874272 | 4.00 |
| 874952 | 4.00 |
| 875348 | 1.00 |
| 874548 | 4.00 |
| 875060 | 2.00 |
| 874627 | 2.00 |
| 874560 | 2.25 |
| 874506 | 1.75 |

TABLE 79-continued

Tolerability scores in wild-type mice

| Compound Number | 3 hr FOB |
|---|---|
| 874610 | 3.50 |
| 874541 | 4.00 |
| 874699 | 1.00 |
| 875880 | 6.00 |
| 875798 | 0 |
| 875445 | 5.50 |
| 875404 | 3.00 |
| 874415 | 3.25 |
| 875831 | 0 |
| 875914 | 5.25 |
| 875351 | 6.00 |
| 875879 | 3.50 |
| 874273 | 6.25 |
| 875458 | 6.50 |
| 875733 | 6.50 |
| 875991 | 6.00 |

TABLE 80

Tolerability scores in wild-type mice

| Compound Number | 3 hr FOB |
|---|---|
| 874218 | 1.00 |
| 756993 | 1.00 |
| 756994 | 1.00 |
| 708202 | 2.00 |
| 757072 | 1.00 |
| 757073 | 1.00 |
| 756996 | 1.00 |
| 757021 | 2.25 |
| 708201 | 3.00 |
| 756997 | 0 |
| 874213 | 1.00 |
| 757074 | 1.00 |
| 708203 | 2.50 |
| 708152 | 4.50 |
| 708153 | 4.50 |
| 756992 | 6.00 |
| 874215 | 5.00 |
| 708200 | 7.00 |
| 757075 | 4.50 |
| 756959 | 4.25 |
| 1008838 | 6.00 |

TABLE 81

Tolerability scores in wild-type mice

| Compound Number | 3 hr FOB |
|---|---|
| 874239 | 1.00 |
| 874252 | 1.00 |
| 874219 | 1.25 |
| 874237 | 1.00 |
| 874221 | 2.25 |
| 1008793 | 1.00 |
| 1008792 | 3.25 |
| 1008794 | 3.50 |
| 937364 | 6.25 |
| 1008795 | 5.50 |
| 1008796 | 5.50 |
| 1008797 | 3.25 |
| 874236 | 4.75 |
| 874238 | 3.75 |
| 875033 | 4.25 |
| 937472 | 5.00 |
| 937473 | 4.00 |

TABLE 81-continued

Tolerability scores in wild-type mice

| Compound Number | 3 hr FOB |
|---|---|
| 1008791 | 6.00 |
| 937361 | 5.00 |
| 874549 | 6.50 |

TABLE 82

Tolerability scores in wild-type mice

| Compound Number | 3 hr FOB |
|---|---|
| 1008806 | 2.50 |
| 1008800 | 0 |
| 1008811 | 0 |
| 1008817 | 2.00 |
| 1008810 | 1.00 |
| 1008803 | 2.50 |
| 1008805 | 1.00 |
| 1008804 | 0 |
| 1008802 | 0.50 |
| 1008799 | 1.25 |
| 1008798 | 4.75 |
| 1008801 | 3.50 |
| 1008807 | 5.25 |
| 1008808 | 3.75 |
| 1008809 | 3.50 |
| 1008813 | 7.00 |
| 1008812 | 6.00 |
| 1008814 | 6.50 |
| 1008815 | 6.00 |
| 1008816 | 4.00 |

TABLE 83

Tolerability scores in wild-type mice

| Compound Number | 3 hr FOB |
|---|---|
| 1008819 | 1.00 |
| 1008829 | 1.00 |
| 1008830 | 1.00 |
| 1008825 | 0 |
| 1008818 | 1.75 |
| 1008824 | 1.00 |
| 1008822 | 1.00 |
| 1008831 | 0 |
| 1008832 | 2.00 |
| 1008821 | 1.50 |
| 1008823 | 1.00 |
| 1008820 | 4.50 |
| 1008826 | 3.25 |
| 1008827 | 5.00 |
| 1008828 | 3.50 |
| 1008836 | 4.75 |
| 1008837 | 6.00 |
| 1008834 | 7.00 |
| 1008833 | 6.75 |
| 1008835 | 6.25 |

TABLE 84

Tolerability scores in wild-type mice

| Compound Number | 3 hr FOB |
|---|---|
| 1008854 | 1.00 |
| 1008845 | 1.75 |
| 1008852 | 2.00 |
| 1008853 | 3.00 |
| 1008844 | 2.50 |

TABLE 84-continued

Tolerability scores in wild-type mice

| Compound Number | 3 hr FOB |
|---|---|
| 1008851 | 3.50 |
| 1008856 | 0 |
| 1008855 | 1.75 |
| 1008786 | 5.50 |
| 1008790 | 6.50 |
| 1008846 | 0 |
| 1008843 | 1.00 |
| 937793 | 1.00 |
| 1008787 | 6.00 |
| 1008848 | 0 |
| 1008789 | 6.00 |
| 1008788 | 4.00 |
| 1008847 | 4.00 |
| 1008839 | 5.50 |
| 1008840 | 4.00 |
| 1008841 | 4.00 |
| 1008842 | 4.00 |
| 1008857 | 6.00 |
| 1008850 | 6.50 |
| 1008849 | 6.75 |

TABLE 85

Tolerability scores in wild-type mice

| Compound Number | 3 hr FOB |
|---|---|
| 1008870 | 1.00 |
| 1008862 | 2.50 |
| 1008874 | 1.25 |
| 1008865 | 1.00 |
| 1008872 | 2.00 |
| 1008871 | 1.00 |
| 1008875 | 1.25 |
| 1008867 | 1.00 |
| 1008863 | 6.50 |
| 1008864 | 5.50 |
| 1008873 | 5.50 |
| 1008866 | 4.00 |
| 1008858 | 4.50 |
| 1008859 | 5.00 |
| 1008860 | 5.00 |
| 1008861 | 6.75 |
| 1008877 | 6.00 |
| 1008876 | 4.00 |
| 1008869 | 5.00 |
| 1008868 | 7 |

TABLE 86

Tolerability scores in wild-type mice

| Compound Number | 3 hr FOB |
|---|---|
| 1008888 | 1.00 |
| 1008889 | 0.75 |
| 1008881 | 1.00 |
| 1008884 | 2.00 |
| 1008890 | 3.50 |
| 1008887 | 1.00 |
| 1008882 | 1.00 |
| 1008879 | 5.75 |
| 1008880 | 5.25 |
| 1008885 | 4.75 |
| 1008886 | 4.00 |
| 1008895 | 5.50 |
| 1008896 | 6.00 |
| 1008897 | 5.75 |
| 1008878 | 6.25 |
| 1008883 | 6.50 |
| 1008891 | 5.50 |

TABLE 86-continued

Tolerability scores in wild-type mice

| Compound Number | 3 hr FOB |
|---|---|
| 1008892 | 7.00 |
| 1008893 | 7.00 |
| 1008894 | 6.25 |

TABLE 87

Tolerability scores in wild-type mice

| Compound Number | 3 hr FOB |
|---|---|
| 1008910 | 0 |
| 1008899 | 1.00 |
| 1008901 | 0 |
| 1008908 | 3.00 |
| 1008911 | 1.00 |
| 1008902 | 0 |
| 1008915 | 2.00 |
| 1008900 | 0 |
| 1008909 | 3.00 |
| 1008905 | 3.00 |
| 1008916 | 4.00 |
| 1008917 | 4.00 |
| 1008898 | 3.50 |
| 1008903 | 4.00 |
| 1008912 | 4.75 |
| 1008913 | 4.00 |
| 1008914 | 4.75 |
| 1008904 | 4.00 |
| 1008906 | 4.50 |
| 1008907 | 6.25 |

Example 14: Tolerability of Modified Oligonucleotides Complementary to Human ATXN2 RNA in Wild-Type Rats, FOB Assessment Modified oligonucleotides described above were tested in Sprague Dawley rats to assess the tolerability of the oligonucleotides. Sprague Dawley rats each received a single intrathecal (IT) dose of 3 mg of oligonucleotide listed in the table below. Each treatment group consisted of 4 rats. A group of 4 rats received PBS as a negative control for each experiment (identified in separate tables below). At 3 hours post-injection, movement of 7 different parts of the body were evaluated for each rat. The 7 body parts are (1) the rat's tail; (2) the rat's posterior posture; (3) the rat's hind limbs; (4) the rat's hind paws; (5) the rat's forepaws; (6) the rat's anterior posture; (7) the rat's head. For each of the 7 different body parts, each rat was given a subscore of 0 if the body part was moving or 1 if the body part was not moving (the functional observational battery score or FOB). After all 7 criteria were evaluated, the scores were summed for each rat and averaged within each treatment group. The results are presented in the tables below.

TABLE 88

Tolerability scores in wild-type rats

| Compound Number | 3 hr FOB |
|---|---|
| 708151 | 2.00 |
| 708154 | 3.00 |
| 755235 | 3.00 |

TABLE 88-continued

Tolerability scores in wild-type rats

| Compound Number | 3 hr FOB |
|---|---|
| 756978 | 3.00 |
| 757130 | 3.75 |
| 757089 | 2.00 |

TABLE 89

Tolerability scores in wild-type rats

| Compound Number | 3 hr FOB |
|---|---|
| 874211 | 2.25 |
| 874251 | 3.50 |
| 874754 | 1.50 |
| 874745 | 3.00 |
| 874785 | 1.00 |
| 874212 | 2.75 |
| 875148 | 2.50 |
| 875032 | 2.00 |
| 874753 | 3.50 |
| 875319 | 2.25 |
| 875341 | 1.00 |
| 875252 | 1.00 |
| 875485 | 1.75 |
| 874388 | 1.75 |
| 875346 | 1.25 |
| 875347 | 1.00 |
| 874792 | 2.00 |
| 875360 | 3.25 |
| 875477 | 4.00 |

TABLE 90

Tolerability scores in wild-type rats

| Compound Number | 3 hr FOB |
|---|---|
| 875650 | 4.00 |
| 875804 | 1.75 |
| 875764 | 2.00 |
| 875966 | 0.25 |
| 875803 | 1.50 |
| 875799 | 4.00 |
| 875807 | 1.50 |
| 875822 | 3.75 |

TABLE 91

Tolerability scores in wild-type rats

| Compound Number | 3 hr FOB |
|---|---|
| 937481 | 3.00 |
| 937480 | 1.25 |
| 937508 | 5.25 |
| 937468 | 2.50 |
| 937467 | 3.00 |
| 937456 | 2.50 |
| 937383 | 1.00 |
| 937385 | 2.75 |
| 937437 | 1.25 |
| 937436 | 2.25 |

TABLE 92

Tolerability scores in wild-type rats

| Compound Number | 3 hr FOB |
|---|---|
| 937680 | 4.25 |
| 937639 | 1.00 |
| 937547 | 0 |
| 937739 | 3.00 |
| 937633 | 3.00 |
| 937611 | 1.00 |
| 937725 | 0.75 |
| 937579 | 2.00 |
| 937510 | 0 |
| 937572 | 0.50 |
| 937511 | 0.75 |
| 937738 | 4.25 |
| 937593 | 2.00 |
| 937592 | 4.00 |
| 937748* | 3.67 |
| 937578 | 1.75 |
| 937618 | 0.50 |
| 937619 | 1.75 |

*This treatment group included 3 rats

TABLE 93

Tolerability scores in wild-type rats

| Compound Number | 3 hr FOB |
|---|---|
| 874218 | 2.00 |
| 756993 | 2.75 |
| 756994 | 2.75 |
| 874239 | 1.75 |
| 708202 | 2.75 |
| 757072 | 1.50 |
| 757073 | 2.50 |
| 874252 | 1.75 |
| 756996 | 0.75 |
| 757021 | 4.25 |
| 874219 | 3.00 |
| 708201 | 3.75 |
| 874237 | 2.25 |
| 756997 | 0..05 |
| 874213 | 1.00 |
| 874221 | 3.00 |
| 757074 | 1.50 |
| 708203 | 3.00 |

TABLE 94

Tolerability scores in wild-type rats

| Compound Number | 3 hr FOB |
|---|---|
| 1008806 | 1.50 |
| 1008800 | 0 |
| 1008819 | 2.00 |
| 1008829 | 1.50 |
| 1008811 | 0 |
| 1008830 | 0.25 |
| 1008825 | 0 |
| 1008817 | 0.75 |
| 1008810 | 0 |
| 1008818 | 2.00 |

TABLE 95

Tolerability scores in wild-type rats

| Compound Number | 3 hr FOB |
|---|---|
| 1008862 | 0.75 |
| 1008854 | 2.25 |
| 1008845 | 2.00 |
| 1008852 | 3.00 |
| 1008853 | 1.75 |
| 1008844 | 1.50 |
| 1008851 | 3.00 |
| 1008856 | 0.50 |
| 1008855 | 1.00 |
| 1008846 | 1.00 |
| 1008843 | 2.50 |
| 937793 | 1.00 |
| 1008848 | 1.25 |

TABLE 96

Tolerability scores in wild-type rats

| Compound Number | 3 hr FOB |
|---|---|
| 1008870 | 1.25 |
| 1008874 | 3.00 |
| 1008865 | 1.50 |
| 1008888 | 1.00 |
| 1008889 | 1.00 |
| 1008872 | 2.50 |
| 1008871 | 1.00 |
| 1008875 | 1.75 |
| 1008881 | 2.25 |
| 1008884 | 3.00 |
| 1008887 | 1.25 |
| 1008882 | 2.75 |
| 1008867 | 2.50 |

TABLE 97

Tolerability scores in wild-type rats

| Compound Number | 3 hr FOB |
|---|---|
| 1008910 | 2.25 |
| 1008899 | 2.50 |
| 1008901 | 2.00 |
| 1008908 | 2.00 |
| 1008911 | 2.75 |
| 1008902 | 2.75 |
| 1008890 | 3.25 |
| 1008915 | 2.25 |
| 1008900 | 2.00 |
| 1008909 | 3.00 |
| 1008905 | 3.25 |

Example 15: Activity of Modified Oligonucleotides Complementary to Human ATXN2 RNA in Transgenic Mice Modified oligonucleotides described above were tested in the BAC-ATXN2-Q22 transgenic mouse model which was generated by using a 169 kb human BAC (bacterial artificial chromosome), RP11-798L5, that contained the entire 150 kb human ATXN2 locus with 22 CAG repeats in the coding sequence, 16 kb of the 5' flanking genomic sequence, and 3 kb of the 3' flanking genomic sequence (Dansithong et al., PLoS Genetics, 2015).

The hATXN2 mice were divided into groups of 3-4 mice each. Two groups were tested with each compound. hATXN2 mice each received a single intracerebroventricular (ICV) dose of 350 μg of modified oligonucleotide. The PBS-injected group served as the control group to which oligonucleotide-treated groups were compared. After two weeks, mice were sacrificed and RNA was extracted from cortical brain tissue and spinal cord for real-time PCR analysis of measurement of RNA expression of human ATXN2 using primer probe set hAtaxin_LTS01321, described in Example 1 above. Results are presented as percent ATXN2 RNA expression relative to PBS control, normalized to GADPH. As shown in the table below, treatment with modified oligonucleotides resulted in significant of ATXN2 RNA in comparison to the PBS control.

TABLE 98

Reduction of human ATXN2 RNA in transgenic mice

| Compound Number | ATXN2 Expression (% control) | |
|---|---|---|
| | Spinal Cord | Cortex |
| 702063 | 17 | 34 |
| 708151 | 19 | 33 |
| 755233 | 16 | 31 |
| 755235 | 8 | 25 |
| 760771 | 85 | 87 |
| 760782 | 13 | 22 |

TABLE 99

Reduction of human ATXN2 RNA in transgenic mice

| Compound Number | ATXN2 Expression (% control) | |
|---|---|---|
| | Spinal Cord | Cortex |
| 708154 | 14 | 14 |
| 756978 | 35 | 46 |
| 757052 | 15 | 19 |
| 757066 | 16 | 15 |
| 757089 | 38 | 61 |
| 757130 | 42 | 53 |
| 757162 | 57 | 60 |
| 757210 | 66 | 75 |
| 874211 | 23 | 37 |
| 874212 | 49 | 52 |
| 874251 | 20 | 19 |
| 874388 | 71 | 75 |
| 874745 | 41 | 43 |
| 874753 | 54 | 60 |
| 874754 | 42 | 38 |
| 874785 | 49 | 48 |
| 874792 | 75 | 84 |
| 875032 | 58 | 58 |
| 875148 | 57 | 53 |
| 875252 | 61 | 67 |
| 875319 | 58 | 63 |

TABLE 100

Reduction of human ATXN2 RNA in transgenic mice

| Compound Number | ATXN2 Expression (% control) | |
|---|---|---|
| | Spinal Cord | Cortex |
| 874217 | 19 | 29 |
| 874279 | 53 | 52 |
| 874280 | 34 | 34 |
| 874281 | 68 | 62 |
| 874282 | 55 | 50 |
| 874702 | 46 | 41 |
| 874752 | 65 | 53 |
| 875341 | 66 | 67 |
| 875346 | 86 | 79 |
| 875347 | 74 | 81 |
| 875360 | 88 | 90 |
| 875477 | 89 | 94 |
| 875485 | 66 | 74 |
| 875650 | 77 | 76 |
| 875764 | 83 | 78 |
| 875799 | 100 | 100 |
| 875803 | 84 | 87 |
| 875804 | 88 | 78 |
| 875807 | 102 | 107 |
| 875822 | 109 | 108 |
| 875966 | 77 | 80 |

TABLE 101

Reduction of human ATXN2 RNA in transgenic mice

| Compound Number | ATXN2 Expression (% control) | |
|---|---|---|
| | Spinal Cord | Cortex |
| 874216 | 16 | 28 |
| 874249 | 30 | 40 |
| 874272 | 50 | 51 |
| 874288 | 48 | 57 |
| 874327 | 65 | 69 |
| 874384 | 71 | 78 |
| 874415 | 84 | 99 |
| 874430 | 19 | 35 |
| 874506 | 49 | 63 |
| 874541 | 48 | 75 |
| 874548 | 42 | 58 |
| 874554 | 32 | 36 |
| 874560 | 45 | 62 |
| 874610 | 58 | 65 |
| 874627 | 50 | 60 |
| 874639 | 39 | 39 |
| 874699 | 63 | 79 |
| 874748 | 42 | 44 |
| 874771 | 31 | 33 |
| 874842 | 45 | 50 |
| 874939 | 54 | 56 |
| 874952 | 56 | 54 |
| 874969 | 60 | 69 |
| 875060 | 60 | 59 |
| 875328 | 54 | 58 |
| 875348 | 54 | 58 |
| 875389 | 60 | 52 |
| 875427 | 70 | 78 |
| 875680 | 65 | 75 |

TABLE 102

Reduction of human ATXN2 RNA in transgenic mice

| Compound Number | ATXN2 Expression (% control) | |
|---|---|---|
| | Spinal Cord | Cortex |
| 875351 | 93 | 110 |
| 875404 | 86 | 97 |
| 875445 | 87 | 95 |
| 875798 | 73 | 90 |
| 875831 | 87 | 101 |
| 875879 | 95 | 111 |
| 875880 | 75 | 90 |
| 875914 | 94 | 104 |
| 937383 | 64 | 81 |
| 937385 | 72 | 82 |
| 937422 | 59 | 83 |
| 937423 | 67 | 92 |
| 937424 | 69 | 83 |
| 937436 | 74 | 105 |
| 937437 | 71 | 92 |
| 937456 | 58 | 77 |
| 937467 | 53 | 77 |
| 937468 | 47 | 76 |
| 937471 | 40 | 43 |
| 937477 | 75 | 97 |
| 937478 | 65 | 92 |
| 937480 | 48 | 64 |
| 937481 | 49 | 57 |
| 937508 | 56 | 66 |
| 937509 | 71 | 81 |
| 937510 | 56 | 63 |
| 937511 | 52 | 72 |
| 937547 | 44 | 47 |
| 937572 | 51 | 70 |
| 937578 | 69 | 99 |
| 937579 | 41 | 60 |
| 937591 | 58 | 63 |
| 937592 | 64 | 83 |

TABLE 103

Reduction of human ATXN2 RNA in transgenic mice

| Compound Number | ATXN2 Expression (% control) | |
|---|---|---|
| | Spinal Cord | Cortex |
| 937593 | 57 | 74 |
| 937611 | 50 | 57 |
| 937620 | 56 | 55 |
| 937633 | 50 | 54 |
| 937639 | 41 | 44 |
| 937680 | 43 | 42 |
| 937725 | 53 | 57 |
| 937738 | 65 | 73 |
| 937739 | 60 | 53 |
| 937748 | 75 | 89 |
| 937754 | 41 | 54 |
| 937792 | 37 | 46 |

TABLE 103-continued

Reduction of human ATXN2 RNA in transgenic mice

| Compound Number | ATXN2 Expression (% control) | |
|---|---|---|
| | Spinal Cord | Cortex |
| 937794 | 45 | 45 |
| 937795 | 53 | 58 |
| 937796 | 64 | 76 |
| 937934 | 68 | 72 |
| 937936 | 51 | 52 |
| 937938 | 56 | 65 |
| 937939 | 50 | 61 |
| 937940 | 69 | 86 |
| 937942 | 68 | 87 |
| 937972 | 71 | 87 |
| 937973 | 74 | 93 |
| 937983 | 61 | 84 |
| 937987 | 62 | 76 |
| 937989 | 47 | 63 |
| 937991 | 62 | 78 |
| 938004 | 61 | 77 |
| 938043 | 77 | 94 |
| 938136 | 80 | 98 |
| 938163 | 59 | 73 |
| 938170 | 77 | 88 |
| 938172 | 78 | 89 |
| 938173 | 67 | 81 |
| 938174 | 67 | 79 |
| 938210 | 94 | 110 |
| 938221 | 78 | 92 |
| 938237 | 72 | 83 |

TABLE 104

Reduction of human ATXN2 RNA in transgenic mice

| Compound Number | ATXN2 Expression (% control) | |
|---|---|---|
| | Spinal Cord | Cortex |
| 1008786 | 36 | 28 |
| 1008787 | 56 | 53 |
| 1008788 | 71 | 66 |
| 1008789 | 62 | 58 |
| 1008790 | 43 | 39 |
| 1008799 | 49 | 54 |
| 1008802 | 50 | 51 |
| 1008803 | 50 | 39 |

TABLE 104-continued

Reduction of human ATXN2 RNA in transgenic mice

| Compound Number | ATXN2 Expression (% control) | |
|---|---|---|
| | Spinal Cord | Cortex |
| 1008804 | 51 | 49 |
| 1008805 | 46 | 42 |
| 1008810 | 35 | 32 |
| 1008811 | 32 | 25 |
| 1008817 | 33 | 31 |
| 1008818 | 27 | 33 |
| 1008819 | 9 | 9 |
| 1008821 | 48 | 48 |
| 1008822 | 56 | 40 |
| 1008823 | 65 | 60 |
| 1008824 | 41 | 40 |
| 1008825 | 34 | 30 |
| 1008829 | 35 | 24 |
| 1008830 | 26 | 26 |
| 1008831 | 48 | 46 |
| 1008832 | 40 | 46 |
| 1008800 | 22 | 25 |
| 1008806 | 18 | 26 |

TABLE 105

Reduction of human ATXN2 RNA in transgenic mice

| Compound Number | ATXN2 Expression (% control) | |
|---|---|---|
| | Spinal Cord | Cortex |
| 708201 | 27 | 30 |
| 708202 | 23 | 44 |
| 708203 | 46 | 57 |
| 756994 | 12 | 16 |
| 756996 | 14 | 13 |
| 756997 | 29 | 40 |
| 757021 | 15 | 28 |
| 757072 | 24 | 36 |
| 757073 | 14 | 19 |
| 757074 | 45 | 49 |
| 874213 | 33 | 42 |
| 874219 | 21 | 20 |
| 874221 | 44 | 47 |
| 874237 | 34 | 31 |
| 874239 | 23 | 23 |
| 874252 | 23 | 14 |
| 1008793 | 64 | 69 |
| 756993 | 15 | 23 |
| 874218 | 8 | 10 |

TABLE 106

Reduction of human ATXN2 RNA in transgenic mice

| Compound Number | ATXN2 Expression (% control) | |
|---|---|---|
| | Spinal Cord | Cortex |
| 937793 | 46 | 52 |
| 1008843 | 44 | 48 |
| 1008844 | 20 | 28 |
| 1008845 | 12 | 20 |
| 1008846 | 36 | 47 |
| 1008848 | 54 | 54 |
| 1008851 | 25 | 23 |
| 1008852 | 10 | 11 |
| 1008853 | 12 | 13 |
| 1008855 | 26 | 23 |
| 1008856 | 26 | 16 |
| 1008867 | 58 | 55 |
| 1008871 | 5 | 7 |
| 1008872 | 11 | 6 |
| 1008875 | 15 | 11 |
| 1008854 | 23 | 24 |
| 1008862 | 14 | 15 |
| 1008865 | 11 | 11 |
| 1008870 | 7 | 10 |
| 1008874 | 13 | 10 |

TABLE 107

Reduction of human ATXN2 RNA in transgenic mice

| Compound Number | ATXN2 Expression (% control) | |
|---|---|---|
| | Spinal Cord | Cortex |
| 1008881 | 17 | 20 |
| 1008882 | 39 | 46 |
| 1008884 | 8 | 11 |
| 1008887 | 44 | 36 |
| 1008890 | 13 | 14 |
| 1008899 | 13 | 18 |
| 1008900 | 30 | 46 |
| 1008901 | 12 | 31 |
| 1008902 | 23 | 31 |
| 1008905 | 69 | 72 |
| 1008908 | 24 | 27 |
| 1008909 | 27 | 50 |
| 1008911 | 21 | 24 |
| 1008915 | 40 | 42 |
| 1008888 | 18 | 14 |
| 1008889 | 10 | 12 |
| 1008910 | 23 | 23 |

SEQUENCE LISTING (3319 sequences)

SEQ ID NO: 1 - DNA, 4712 bp, Homo sapiens
acccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcctccttctccccctcgccagcccgggcgcccctccggccgcgccaacccgcgcctccccgctcggcgcccgcgcgtccccgccgcgttccggcgtctccttggcgcgcccggctcccggctgtccccgcccggcgtgcgagccggtgtatgggcccctcaccatgtcgctgaagccccagcagcagcagcagcagcagcagcagcagcagcagcagcaacagcagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcagaggtcgaaacagtaacaaaggactgcctcagtctacgatttcttttgatggaatctatgcaaatatgaggatggttcatatacttacatcagttgttggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgcatgtcccaaattaccatacaacaaggagacaagcccttctttctactttgccatttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgaaaaaaaaaaa

SEQ ID NO: 2 - DNA, 151001 bp, Homo sapiens
tcccaaagtgctgggattacaggcgtgagccaccacactggccaaaacttgttcttaagattgtattctgggaccttgattccaatcagagaaaagtgattgtatttttttatttttattttttttagataaagtttcgctcttgttgcccaggctggagtgcagtggtgccctctttggtcactgtaacctccgcctcctgggttcaagcgattctcctgcctcagcatcctgcgtagctgagatcacagatgcccaccaccacgcccagctaattttttcgtatttttagtagcgatggggtttcaccatgttggccacgctggtcttgaactcctgacctcaggtgatccatccgcctcggcctcccagagtgctgggattacaggtgtgagccaccgcgccaggccaagtgtttgtatttctattaaagaaagaatataacgggacaccattgacgacctgctccattgcaggcctccttgctgttcctcagactcccccctcagagcctttgccctcgctgtgccctccacctggagcgtttctccccaggatcctcatgcccatgctcatttgggtccctgccccatgtcaccctctccaggagcttcccctcacagcagccctggcctgtaccacagccgggtacaggtatttttttgtttcaactggttttttagttccagtttcctttaggttactttatttatttatttatttatttattttttgagacggagtctcgctctgtcgcccaggctggagtgcatgatctcggctgactgcaacctccacctcccggattcaagcaattctcctgtatcagcctcccgagtagctgggattacaggcgcccaccaccacacccggctaatttttatatttttggtagagacggggtttcaccatgttggctaggctaggttaatttttaaagggttttgcaatggtcccttgatctactttttaccttagatgggaaataaaactgatttcctacattggcagaatacaatgatcatttttgcctggactatctaggaggttaatttcagttggactactgaaaactgctggttcaatcattctccacgtttatctaagtctttacctttatctggacagttctaggacattgaggggaattttggtgtttcttcccctattatttcctgaagtcatttcactttaaaaaacaatagattcactgctcaaaaaaaaaaaaaaaagttacctactttctacttgcttccagtttaactgcaacacattttaaaaagagtctactgtgctggctgggtaagttaaattaaaacttctaaagggtccaaggtctaaagttcgcacattgttttgaggtcggctctgtctctaccgagggagatcccattatccgtagttctaccagtcccaatcccatatatttcctttagaatctcatgaatgaggaaaaagaagttcaagtgagggaacataggttcaaatgaaggtcagatacctaaaagagttttctggtgactgtgcgcggctggggtggaaaaagtggggaaaaggtacccagatgtgggtggccccggagggttgctccactccagccccggcagggcaggacagcgcggcctgcctggtagatgccccgagccactggagcgcctactgtgtggcgggcgggggacggcaggaaaacggcaggatgctgtgtcccctgaatctggcagggttctaggtgctttacacgtagcaagacacattctccgccccaaggcactcgcagtcagtccattttctgggttgcatcaggtgggggcaaactaggtccccgcagaagtgaagatgctgaaggaatacagtaggagaagaaatgcttctctcctgtcctccacaccaggcaggccccagaggctgagaccgacacgccctccccgaagggcagacccgccttgaggaaggcggatccgggtagggaccgccgcctggccctcacccgacccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcctccttctccccctcgccagcccgggcgcccctccggccgcgccaacccgcgcctccccgctcggcgcccgcgcgtccccgccgcgttccggcgtctccttggcgcgcccggctcccggctgtccccgcccggcgtgcgagccggtgtatgggcccctcaccatgtcgctgaagccccagcagcagcagcagcagcagcagcagcagcagcagcagcaacagcagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcaggtgggtgtcggcaccccagccccctccgctccgggcccggcgtcccctcccccgcggcccgcgccgccgtccccgccccgtgacccgccgggctacccggggtgggctgggggccggcagcgcgggggagactcgctcgggcctgagccccgaggctcggccggtgggcgcagccggggtcctctgggattgtcaggcctgtccagcctcccgcagcatccccgccccctcccccggcggtcaagatggagggagcgggcggcctcccctccccacgcgtgttgggaggggttctcgggtagcggcgatggtcagccccggctcccccttccgcacgatcctccgcccgcagcgtggggatgctcgggcagctcctccactcccggtttaggtgtgaacgttggaggggtctggaggctgtggtggcgttttccggaacatgtccccctccatgggggacatctctggaggggagaagttagggccgcgtcccccgtgccggttaaaggggtaggcaccgggctcctccggaatcatcagggtctgtcggggctctctccccgccccctccgagtcctgggaaagatcggaggacggggtggagacaagtgggccttggcccccgcacccctctgcgttcgtgtccgaggcggcggcgggggctcccgaactcccctgaaatcgtggggctccatgtggcctccggcagcgttccaccctcccccacctggggaagggaaggggtggggagtgcccggccccgtcccggccttcctccttcccccgccagacctctccggcgcgcgggtggtggccgatccgcattgctgttcgaggccgcagtggagaaggcgcctgtggaacatcggtgggtgagggctggacccaggctggaccctggagatccggggtggcggtgctggtggcagggggcgggcaccctgcgcacttatcccaacccccgccccaatttcggaaatgctaggagagagagattgcagcaggggacgtggtcgggttcctgaaggcagaaaggcgggtgtttactagcgtctttttccctcctaagccggggttgtagtaggggctgggggctcagtgttgtcccggctaactgggtttgactcgagggtgtgtttgtgcaggagggcctgttgggggtggcgggcggttgtcagttcgtatttcacgaactaagaaaatgcttagtgttcaaagggagaaggaaacgtcaatagactccattccattgtggccggtgtccttaacttcgggagtgccgccagagcttaccaagggcacgcaagtccatttcccttgtgcctcaagtccatccgtgttgtaggcactactgtgccttctttaggcctaggccgccggcttgacggcgggtgaccggcgtcctccttaaataggcatcttgggctttggaaggtggaataagaggatttttcattcacccgagttttctttttgaaaacacattttcagcaacccatttccaaagaatttttatttacagcagaaattccccatcaagaggaatcagctggtttttaaggaattctgctgccttcaaagggggcggaaacagtcggttatttgactttacacgccccgcccccccttccccttctctgagtctgaagcatcccaaacactacttagccaaactagttcagatgaagtgatcgtttccccaagtagggtaacttcagtttccctttttcgttggcatctagcgaaaaatgaaaaaatttaaaatacaacttttatagaaaaggatgtattctgtttttactttcttaggtattaggaagagatttggcagataattcaacatgttcaaatatataaacattaaaactaaggttattaagttgcattgactactaggcttaaaaattagattataagagaatttgctcctgagtagtttgagtgatcaaagatatttggaatgttttagtaccacaaggtcttttttctgttccttgaggctttacaacaatttaaggttaatttagatttttccttgctttaagttcttttacttgagacctaaatggcagcccttattctttctgatgaataggtgaaattttgtttactgtgttggatttgtgtaatgtgaagttttattcttgaacagatcgttaatgtacttgtagaattactttgaatttgaatcactttcctgcattccttgtaaataagtttcagcttctagaatctcctcacttaggtttgtgcgtatcaacagtgaaaataagtctctgagagcaagggtgaaaaaaaatgcagcattcggtttgacaagtttcgagatagcaaaatatgcttgaaagtctggaaattcacatctgctttaagaaacatttcataatttgactttgtgtgtgtgtgtgtgaatagtttttcatgactttcagaagtgatttattttgttctttgttatatatatttttgaaggtggctgttttaggaaagataatgtaatcacaatattagaacataattttactgtaatctaattttgtgtgtgtgtgtgtgtgtgtgtgtgtgtgtgtgtgtgtgttttggatggaatctcactctgtcgcccaggctggagtgcagtggcctgatctcagcttactgcagtctctgtctcctgggttcatttaagtgattctccagcctcagcctccccagtagctgggattacaggttcgtgctaccacacctggctaatttttttgtatttttagtgaggacgggattttgccatgttggccaggctggtctcgaactcctgacctcaagtgatccgcctgccttggcctcccaaagtgctgggattacaggcgtgagctactgcccctggccaatttttgtatttttagtagagatggggtttcaccatgttggccaggctggtctcgaactcctcctgacctcaagtgattcgccagcctcggcctcccaaagtgccaggattacaggcaggaatgagccactgcccccaaccatcagtctaattcttatttttgctttttaccttttcatttttatgtagtagaggtgattgtgtatgttattttgtagttagcttttttcccctgaacgttgtattgtaaatgtaaatttttttttttttttttgagacagagtctcggtgtttgcccagtctgaagtgcagtggtacgatctcagctcactgcagcctctgactcctgggttcaagcgattctcccacctcagcctcttgagtagctggggctacaggaatgttccaccacgcttggctaatttttgtatttttggtagagacaaggtttcaccatgttggccagtttggtctcgtactaccgacctcaggtgatgcgcccgcctcggcctcccaaagtgctgggattgcaggcgtgagccactgcgcccggctgtaaggtttttacttaaccattctattgttgggaattgggtttccacttttttgttatagatagtggtgcagtgaacatttttaaatagctttttgcttcagtgtaattatttccttagagaaagttaccaagagtggttttactagttcagagggcttcaggatttttatggctcttgctagcggtgctctattattctttagaagacttgtattacttccagtgtcaagaaggttgctcttccatggaatggtttctttgtagtttgtcaaatattgtggggaatttttaaaggaaaaattgcatttttactgtcaagtgcatatattattaagtgcttttgttagttactggattattgatatttgagtttaatttggttcctctgaggatttaataaggtaatatatgtgaagatgttttgaaacctgtaaccattattattaatgagggtacttggtttatctgtcgtgctgatagtactgagtaaagtgcaggaatgaaattcctgaggaactgttctaaagctttgttgttgttgttaacctttctttttcatctgaaagtgttttttattagctgctagcctatgaccaagttatttttggtaacttttttgtaatttcatggcactattgggaattttcgctggttgactcttcttcttctacattcccttccccattaaaaataaaaatatggatttacaattgttactctattcctaaacctaaataatatgacattagaattgcttgggatacaggattcagtctgaataaaatatttttcttttagtgattttcagcttagtatttttactgcttctttctcttgaggcattgcaacttaaaaattgtgctgtttagccaggcgcctgtaatcccagctacttgggaggctgaggcaggagcatcacttgagcccaggaggcggaggttgcagtcagctgagattgtgccactgcactccagcctgggagacagagtgagactctatctcaaaaaaaaaaaaaatgtgctgtgatttaatgtagttgttcatcatgcttccatttaaatttcagtgagactgttcatcttttgcagttaaatatcttgtagaagggcctaaaatatctacgttgaatacagctttattgaagcatctatgtacatggggtttttgggatgaatcagtgaataaagcaaacatattgtccttttggagtttacattctaatgtgactaggcagacaatgagacattaaattaccagcctatgtataatagtgtataagagctatggaattagaagaaagcagattaaaggtatagggagtgtggggaggggaatgagttacaattttaaatggattgggggaacttaattgaggagctaacatttgagcaaagatttgaaggttgggtatttagccgtttgctttttatctaggttaattagtcatgtggcttcattagtaatttataaggtttaaatggcatcatcctttgttattcttttatgtgcacattgatactaaccatctctgaagttagaccaaaaaagttaattgacattgagggtcattagaggtaaattgtagatggctattactaaccaaagagacatgttttgtttttcttttgggcttacgtattttacctaattagtttagtttttgtttcaagtatgtggagaaaataaactttttaagtttgggccaaaacttgctttggttttctttttctttttctttttttttttttaagagaaaaatgtaagcctgtagttgcttaaagattccacattctgaaacagtgaaaacatgggatcagtcatggtgttcctttttttggttaaatgtaaacttgtattttcagtgttactctaattagcaatggtttatacttctacataagggatgttaactcatattgtagctatttaatagccatatattttgacttaaaggaggatctcaaggccaggcgcggtggctcatacctgtaatcccagcactttaggaggctgaggcgggtggatcacctggggtcaggagtttgagactagtctggccaacatggtgaaacccccatctctactaaaaatacaaaaattagccgggcatggtggtgggcgcctgtaatcccagcttcttgggaggctgagggaagagaattgcttgatcccggaggttgcaatgagtgcggaggttgcagtgagctgagatcatgccattacactccagcctgggcaacagagcgagactctgtctcaaaacaaacaaacaaacaaaaaaaggaggatctcatttttttgtcctaaatagctacagccgtgttagaactgtcaccttagcaaagtattgtttttttactttgaaacgaattttaaggttttagaagattgttctctagaattacaattttctgttttgactagtgatagtattttgatgttgtgtaaatagttgagcatgaacaaaaccctatttttttttttagctatttcaagtgattgtgacaacttcaacggagatgtaaacagtttattaacagtcacacctattatcttttttttttttttttttttttgagacggagtcttgctctgtcgcccaggctggagtgcagtggcacgatctctgcttactgcaacctttgcctcccgggttcaagtgattctcctgcctcagcctcctgagtagctgggtctacatgcgcacaccaccacgcctggctaatttttgtatttttagtagagacagggtttcaccatgttggctagaatggtctcaaactcctgacctcaggtgatccacctgcctcagcctcccaaagttctgggattacaggcatgagccaccgtgcttggccgctgccgtatctttttaaatgaaagtacttgtgttttttttgtttttttccaaaggatatctgggtcatctatgatgttactgttaccatctaagggtttttttgtttgtttttgagacagagtctctgtcgcccaggctggagtgcagtggcgtgatcttggctcactgcaacctccgcctcccaggttcaagcaattctcctgccttagccctcccgaatagctgggattacaggcacccgccaccatgcctggctaagttttgcatttttagtagatatggagtttcaccatgttggccaggctgctcttgaactcctgacctcaggtgattcgcttgcctcggcctcccaaagtgctgggattacaggcgtgagccacccccgcccagcctcatgagctaaggtgttttttttttttttgagacagttttgctctttcccaggctggagtgcagtggtgcaatctcagctcactgcaacctctgtttcccgggttcaagcgattctcctgcctcagccttctgagtagctgagattacaggtgcctgctaccccactcagctaatttttgtatttttagcagagacagggtttcaccatgttggttaggctcatctcgaactcctgaccttaagcgatccacctgccttggcctcccaaagtgctgggattataggcatgagccaccgtgcgcagcctaccctgtctcttaaaaaacagtaacaacaacaacaacaacaaaaaatcctaaatcttaaaaatggaaggcaaaaactctaagctttgagagattaggggacttgcccaaagcaatatttgtaggattttattacacctctccctttatttatttttttagagtcaaggtctccctctgtcacccaggctggagtgcagcctcaatctatggggccaagcatttctcctgtcttagcctcctgagtagctggaactacaggtgtacaccagctggctaacatttaaattttttgtagagacagggtcctgccatgttgcccagattggtctcaaactcctgggctcaagtgatcctcctgcctcagcttcccaaagtgctgagattacaggtgtgagccactgcaccgagccccctccctttatttttatttttaaattttaagttctggggcccctcccttgaaataaatagaaacgtaatatatacacaagatcatgctgtgtattttaaggcaatggtcctcaacctttttaacactagggaccggttttgtggaagatggtttttccataggggcaggggatgattttgagatgaaactgttccaccggccgggcacggtggctcacgcctgtaatcccagcactttgggaggccgaggcgggcagatcacgaggtcaggagatcgagaccatcctggctaacatggtgaaacccccctctactaaaaatacaaaaaaattagctgggcgcggtggagggcgcctgtagtcacagctactccggaggccgaggcaagagaatggcatgaaacccgggaggcagagcttgcagtgagctgagatagcaccactgtacttcagcctgggggacaaagtgagactccgtctaaaaaaaaaaaaattgttccacctcagatcattatgcatttgttagattctcataaagagcatacaacctacatctcttgctatatgcagttcccagtagggtttgtgcttctataagaacctaatgctgcacctgatctaacaggtggggctcaggtgctaatgctcacacagctcctgttgtgcagtctggttcctaacaggcctgtttttttttttttaattagatggagtctcgctctgtcaccaggctggagtgcagtggcacgatctcagctcactgcaacctctgcctcccgggttcaagcgattctcctgccttagcctcccatgtagttggtactacaggcgcacactgtgatgcccagctaatttttgtatttttagtagagacggggtttcaccatgttggccaggatggtgtcgatctcctgaccttgtgatccgcccaacagcctcccaaagtgctggaattacaggcgtgagctgctgcgtccggccccctaacaggcttgttttatggaatacagtcacggacagtacttgcccttcaggatatctttttgtaaccttgattttggcttgctaaaataggaggtctattttcttttctttgtttttaatgtatgtggttctgtacttacgtggtgtgaaatctacataaatgttaaatccttggttatttatttattttgagacagagtctcactctgtcacccagtctggaaagcagtggcataatctcggctcactgtaacctccacttcccaggttccagtgattctcctgcctcagcctcctgagtagctgggattacaggcatgcaccactacacctggcaaatttttgtatttttttttagtagagatggggtttcaccatgttggccaggctcgtcttgaactcctgaccttaggtgatctgcctgtcttggcctcccaaagttttgggattacagcatgagccactgcgcctcgccttatttttttgagacaggttctagctctgtcacccaggcgggagtgcagtggtgccatcatggctcattgcaacctcgagttctcaggcccaagtgatcctcctatctcagcctcctgagtagctgggaccacaggcatgcgccactatgcccagcaaaatttttgtttcactctgttgcctagggtggggtgcagtggcaggatatcggctcagtgcaacctctgcctcttgcgttcaaatgattctcatgcctcagcctcccgagtagctgggattataggcatgcgccactacacctggctaatttttgtattattggtagagatggggttttatcatgttggccaggctggtctcgaactcccgacctcaggtgatccatataccttggcctcctgaagtgctggaattacaggcataagccactgcgcctagcttttttgtttgtttttattttgtagggacagagattttacctgttgcccaggatggccttgaattcctgacctcaaacaatttgccctccttggcctcccaaggtgctgggattacaggtgtgagccactatgcctggctggttttttaaattattattattgtttgtgtgtgtgtgttgcaggatcttaccctgtcacccaggctggaatgcagtgatgtgatctcggcttactgcaacctccgcctcctaggttcaagtgattgtcctgcctcagcctcctgagtagctgggataacagctgtgtgccaccatgcctggctaatttttgtatttttagtagagatggggtttcatcatgttggccaggctggtctcgaactcctgaccttagatgatccacccgcctcgtcctcccaaagtgctgggattacaggtgtgagccaccgtgaccagtttggtttagtttttttttttttttttttttttttttttttttgagaaatctcgctctgtcgcccaggctagagtgcggtgacacaatctcagctcactgcaagctccacctcccaggttcatgccattctcctgcctcagcctcccgagtagctgggactacatgcgcccgccaccatgcccggctaattttttttatgcattttaagtagagatggggtttcactgtgttagccaggattgtctcaatctcccgacctcttgatctgcccgcctcggcttcccaaagtgctgggattataggcatgagccaccgcgtccggcctggtttggtattttttttatgagtctgggttgtttatgaaaacttgtcacagctgttaaccttaactttttttttttcttttttttccgagacggagtctcgctctgtcacctaggctggagtgcagtggtgcgatctcggctcattgcaacctctgcctcccaggttaaagcgatttttctgcctcagcctcctgagtagctgggactgcaggcacgcaccatctcgcctggctaatttttgtattttagtagagatggggtttcaccatattggccaggctggtctggaacttctggcctcaagtgatccacctgccttggcctcccatgcctggcaaccttaactttttatttgctggtaattatttgtgtttgcattcatgtgaaaatttgaaattctcattaacatttaaagattcttacatagattgcttgtaattttaaccctgaagttgtgtcaagtgactttacaatgtcaatttgttttatttatttatttatttatttatttatttatttttgtgataggatctggctctgttgctaaggctggagtgcagtgttgcaaatacggctcactgcaacctctgtctcccgggttcaagccatcctcccacctcagcctcccaagtagttggaactactggtgcgccccacagtgcctgcctagtttttttgtattttcagtagatgtggagttttgccatgttgatcttgaactcatggcctcgagtgatccaccccacttaggcctcctaacatgctggtgttacaggtgtgagccactgtgtccagcccgaaaatgtcagtttcgtgccatgattaatagctaactacattttgggaatgtaataaaatttcattctataatgaagtctttgtaaaactcattagttgtggtatgaggcttgtcggcaatataagtgaacgtggtttatttttattaactgtatcagaactttagaatgttggtctcctgaaaccattgccttgagaggctttattgaacagtgttgccaatgatcagtttttttttaaatttccttttttttgagactgagtcttaccctgttggccaggttggagtatagtggtatggtcatggctcactgcagcctcaacatcctgggctcaagcagtcctcctacctcagtctcccgagtagctggaactacaggtgtatgccaccatgcctggcttttgtatattttgtagagacagggtttagccatgttgcccaggctggtctcaaactcttaaattcaaatgatccacccacctagttttcccaaagtgctttaattacatgtgtgaggcaccgtggctggccaggtcaaatatttttcattgacgtttttcatattgctttttaaagtcatgttaaaatattcttaataatttttctaagtggaattaatcttgattataattttagttttttataaagggcgggttttgaaacaagtactgcatttttcttttcgggtttataaacatttgctgtggactttgtgcagttaactattttcattcctgaaacacatttcgaaatcaggaattgaagactaaatgtcttttcactgaagcttgagcagattttagaaaggggagttcttttttttttttttttttttggtagaaatgggggtcttgttatgttgcccaggctggcctccaacttctgggcttaaactgtcctcctgctttagcctctggtctggagagttctttatggcctctttgagaacttttactttacacatgattctatctagctttcttttctgatgtacatattggcagcaagtagaaaagcaatgttttcagaggcagatatattaacagcaatgagaaataacagtagcgtgatagaaagttgaaagacttagctgggtgcggtggctcacgcttgtaatcccagcactttgggaggccaaggagggtggatcacttgaggtcaggagttcgagaccagtctggccaacatggtgaaaccctgtctctactgaaaaacagaaaaagggccgggcgtggtggctcacccctgtaatcccagcactttgggaggttgaggagggcggattacaaggtcaagagattgagaccattctggccaacagggtgaaaccccatctctactaaaaatacaaaaaaattaaatgggcgtggtgatgtgtgcctgtagtcccagctactcgggaggctgaggcaggagaattgcttgaacccgggaggcagaggttgcagtgagccgagatcgggccactgcactgacgacagagggagactccgtctaaaaaaaaaaaaaaaaaaaaaaaaccagacttggggctgggcgggcgcctgtaatcccagctacttgggaggctgaggcaggagaatcgcttgaacccgggaggtgaaggttgcagtgagctcagattgtgccactgtgccccagcctgggccacagagcagagtgagactctgtctcaaaaaaaaaaaaaaagtttggaagactggtggctgggcatggtggctcacacctgtaatcccaacactttgggaggctgaagcaggcagattacctgagcccaggagttcaagtccagcctgggcaacacagggaaaccccatctcaacaaaaaatattaatacaaaaaatttagccagtcatggtcgtgcacttctgtagtctcagctacttgggaggctgaggcaggtggttcacttaagtctggatgtcgaggtgagccatgattgcaccactgcactccagcctgggcgttaaaatgagaccttatctcaaaaaaacaaagcaaagagcctgggaactactaaaatgggaactactaaaaaacagacacaagagctcaacaagtataccattctgggaggtttttttttttttttttttttttttttttgagatggagttttgctcttgtcacccaggctggagtgcaatggcgccatctctgctcactgtagttccgcctcccaggttcaagcagttctcctgcctgactcctgagtagctgggagtacagatattggtcacacaccgggttaatttttgtatttttagtagagacggggtttccccattttggccaggctggtctcgaactcctgacctcaggtgatccgcctgcttcagcctcccaaagtgccgggaccacaggcgtgagccaccgcacctggctttttttttttgacatagaatcttgttctgttgcccaggctggagtgcaatggtacaatcttggcccactgcaacctctgcctcccagcttctagcgattttcctgcctctgactcctgagtagctgggattacgggtgcccgccaccacacccggataatttttgtatttttagtagagatggggttttgccatattggccaggccggtcttgaactcctgacctcagatgatccacctgcctaggcctcccaaagtgccgggattacaggcgtgagccaccactcccggcctgggagttttgactgtaagtttatagctgtatatcttaggccctaagggcattactgttttatagcacagtgtagttagttaatgtgctcataatggtgactcataacaccaggttaaatgattttttatatctcccaaagaagtatttttcaatctgcagatcatgaccccttagtagattgtgaaacacattagtggattatgacaagcatttttagaaaaatgaaaaagaataagaagtgttaggatgcattgcattattgaaataattgtttttgagatggagtttcgctcttagttgccgaggctggagtgcaatggcccgatctgcctcccgggttcaagtgattctcctacctcagcctcctgagtagctgggattacagacatgctccaccatgcctggctaattttgtatttagttttagtagagatggggtttctccatgttggtcaggctggtcttgaactcctgacctcaggtgatccacttgcctcggcctcccaaagtgctggggatacaggcatgaacccctgtgcccggcctaatttttgtatttttagtagagatggggtttcaccatgttggccaggatagtcttgatctcttgacctcgtaatctgcccacctcgactcccaaagtgctgggattacaggtgtgagccactgcacccagctgccaagaattgttttaagctttggtttgagttaatgtatatataccgcattgtaattcaaaatgtaatttttggccaactctgggcacattgcctatggactagtcctgctctgccacgagcagcaacagttcaatgaattttttttttttttttttttttttttttttttttgagacagggtctctgtcaccaaggctagaatgtagtggtgcagtctcggctcactgcaacctctgtttcctgggctcaagcgatcctcccacctcagcctcctgagtagctgggagtacaggagcacgctaccatgcctggctaatttttgtattttttgaagagatgaggttttgccatgttgttcaggctagtcttgaactctggagctcagatgatccacccaccttggtgtccagaaatgctgggattacagggatgagccaccgtgcctagccaaaaatttttttttaagtaattttttattgatatagtcaaaaaagttactgctttagagccagagaaacgcagtaaaaggattgagaaagagttttgaggttatatctaagctagggttgtcagatttggcaaatagaaatacaggacactcagttaaatttgaatttttgatgaacattgaccagttttttagtataattgtgtattaaattgcatagaaaaaagttatttatctaaagttgaaatttaactgagcatcttgtattttatctggcaactccagtctaagctggaatcatggttcactgttttttttttttttttttttttttgagtcggagtcttgctgtgttgcccaggctggagtgcaatggtgcgatcttggctcactgcaacctccacctcctgtgttcaagtgattctcctgcctcagcctcctgaatagttgggattacaggcacccaccaccatgcccagctaatttttatatttttagtagagacggggttttcgccatgttgttcaggctggtcttgaactcctgacctcaggtggtccgcccacctgggcctcccaacgtgctgggattacaggcatgatctaccgtgcctggccatggttcactcttcagtaactaaaatttaagctctatgaaagcaggaactttgttttgttcactattgattgtatccctatttcttgaatggttggcacttaactgcttggtcacatgtttgaatgggcaagttactcagccactctcaggcttagtttatttacctattaaaagagaaagaatatcttccttggctgggcgcggtggctcacgcctataatcccagcactttgggaggctgaggcgggtggatcacgaggtcaggagatcgagaccaacctgggcaacattgtgaaacctcatctctactaaaatagaaaaaattagctgggcatggtggtgcgcatctgtagtcccagctactcgagaggctgaggcaggggaatcgcttgaacccaggaggtggaggttgcagtgagccaagattgtgccactgcactccagcctgggcgacagaacgagactctgtctccaaaaaaaaaaaaaaaacaaacaaaaaaaaaaactgagatactggccgggcgcggtggctcgtgcctgtaatcccagcactttggaaggccgaggcgggtggatcacgaggtcaggagatcgagaccgtcctgcctaacatggggaaaccctgtctctactaaaaatacaaaaaattagccaggcgtggtggcgggcgcctgtaatcccagctacttgggaggctgaggcaggagaatggcgtgaacccgggaggcagagcttgcagtgagcggagatggtgccactgcactccagcctgctgggcgacagagcgagactccgtctcaaacaaacaaacaaacaaacaaaaaaactgagatactaaagtcttaatattttctgtttttatgtatttattttttgagatgggatcttgctgtattgcccaggttggagtacagtattgtgatcatggcttattgcagcctttaactcctgggttcaagtgatcctcccacctcagcctcctgagtagctgggaccacaggcacatgcaacatcacaccctgcagttctttttttttttttgagacaccgtctcgctttgtcacccaggctgcagtgcgtggtgcaatttctgctcactctaacctccacctcccgagttcaagcagttctgcctcagcctcctgagtagcttgggaccacatgtgtgtgccatcatgcctggttaattttttgtatttttagtagtgacagggtcttaccatgttgcccaggttggtctcaaactcctgagctcaagtgatctgcccgccttcgcctcccaaagtgtctgcgccctacaatttaaaaaaatttttgtagagacagtctcactgttacccgggctggttttgaacttctgccctcaagtactcctcttgccttggcctcccaaagtattgaaattaaggccatgaggcagcacacccagcctaaattcttcttatgttctgttcttggcacatagtagatgttcaacaatgtagagtcaaacgcatttggagttggaatggctctggtgttttttttttttttttaaaccagaaacacgtgcagtttattgaatgccattgtagaaaagtgtgtgaggataaacggctgatagagaacttggctctgggggcagggcgaggaatggagggtggatggagtacatgggaatcagatcacgggcagagctcctggcctagataatgcctcctgatctgttgatagacttgaaagatcaacactgggatgatgctgagcagaatggtcgtaatgatgcgcacaatcagggcccagatgttcaggcacttggcggtaaaggcataggcctgggccctgatcaggtcgccaaccatcttcttgtccctagacttcacggagtaggccaatgctatgaagcccaggcagcaggagttcatgaagtgggtgttgaacagggaccagacgacatggtcgggcacggagttctcgctgtggatggggatcacggtggacattgggggagcagggttgtggggtgcccccagcacagccacctcttgctcctccttgagcatctcatagttagggggatggccgatgttggcaggagtgaagaggtttggacattgtggttcatggtgtccagggaagaccagctgtggtcgggttgctggggtggttctcagtgggcccctccctttccctggtagtttggatttctctggctctggtggttttttagtactcattctatttacgggtgaagaaattgagaccaagagggttatttaccagagtatctcatcattggctgcataactggcattagaatctgatgtacttttatttctaatacatttctttttttttttttttttttgagatggagtctcgctctgttgccgagcctagagtgcagtggggcaatcttggctccttgcaacctccacctcctgggttcaagctattcctgtctcagcctcccaagtagctgggactacaggcacctgccaccacagccggctaggttttgtattttagtagagatggggtagcaccatgttggccaggctggtctcgaactcatgacctcaggtgatccacctgcctcggcctcccagtgctgggattataggcatgagccaccatgcctggcctttctttgtcgtttcctttctttctcttcatccctcctctccttttttcccctccccgctgcctcctcctgtcttcccttctttccttcctttctctcctttttattttttcctttctttttctttctctgtctctcccaacccttcctctctccctccctccctccccttctctctccccccctccctccccttctctctccccctccccttttgttcctaagagacagggtctccttatgttgctgaggctgaccttgaactcctgagcccagatgattctgcctccttagtagctgggactacacccacctcccgttccgttgtcatcttttttttttttttcttttttggagacagaatcttcctctgttgctcagggtggagtgtagtggcacgatcatagcttactgtaactgtgtaacctcgaattcttgggctcaagcaatcatcccatcatcccacctcagcttgctgagtacctggggctacaggtgtgtaccaccatgtccggctaattacttttcttatttttaatttttcggagataggatcttgctctgttgcccaggctggtgtcaaactcctgggctcaagtgaaactcttgccttggcctcccaaagtgttgggagggattacaggcatgagccactgcacccagcctcctctttcttcccatttaactcctaaccacaccgaactttctgtctgcagagaggagcattggtcagcagttcacaaaatggctaggtgtgatggcgtgcacccatagtcccagctacttggggagctgaggtgggaggatcgctggagcccaggagttcaaggccctgggcaacacagcaagaccttatctctggctgggcccagtggctcacgcctgtaatcccagcactttgggaggctgaggtgggtggatcacctgaggtcaggagttcgagaccagcctggccaacatggtgagaccctgtgtctactaaaagtacaaaaattagccaggcacggtggcgcgctcctgtaatcccagctactcgggggggctgagacaggagaatcacttgaacccaggaggaggaggttgcagtgaaccaagaacacgccactgcactccagcctgggtgacatagtgagactcttatctcaaaaaaaaaaaaaaaaggtcgtctgtactattgcatgttagtagtttctttctgcttattgttgagtagtagtctattgtatgcatgtaccagtttgttcatctagtggtggacattgagttagcaggttttggctattaaaaataaagctggaggccgggtgcgatgtctcacgcctgtaatcccagcattttggaaggccgaggcaggcggatcacctaaggttgggagtttgagaccagcctgaccaacatggagaaaccccatctctactaaaaatacaaaattagccaggcgtggtggcgcatgcctgtaatcctagctactcaggaggctgaggcaggagaatcgcttgaacccgggaggcagaggttgtggtgagccaagattgcaccattgcactccagcctgggcatcaagagtgaaactccgtctcaaaaaaataaataaataaagctggtatgaatatttatgtacaggttttgtgtgaacatatgattttatttctcttggttggaatgcatagaaatgagattgctgggttttgtggcaagtgtttatttttccagggtacatataatcctgtgagtgtttatttaattttaaaagtaattgctaaactgtttgctaaagtgactgctatattttctttccctagcagtgtatgaatttttttttgaggcagggtcttgctctgtcacccagggtggagtgcagtggtgcgatattgtctgactgcaacattgacctcctgggctcaagtgatcctcctgcctcagcctcctggctgggaccacaggcatgtaccaccacacctggtagtttgctttgatttttagtagagaagaggtctcactatgttgccctgggtggtgttgaactcctgggctcaagtgattcatctacctcagcctcccaaagtgctgggattatagatatgagcccctgtgcctggcctcattgtggttttaatttgcatttccctaatgcccagtgatattgagcattttttcatgtgtttatttgacattcataccatctttggtgatgagaaactatgtttatgcattgcttaatgatggggatgtgttttgagaaattttttcggtgatcttatcattgtacaaatatagagtttacttacacaagcctagatggtatacctactagacacataggctgtcgtacagagtattactcttaggctacaaatctgtatagcatgttgcggtactgaacactgttggcagatgtaacataatgttaagtatttgtgaatctaaacatatctaaacatagaaaaggtgagtaaaaatacagcgtaaaagataaaagtggtatatctgaataggtcacttaccatgaatggagcttgcaggacaggaagttgcttgggatgagtcatttatcagtggtgtgtgaatgtgcaggcctaggacattactgtatgctactgtagacaaacactgaacagttaggatacactaaattgataaatatctttcttattttgttttttgagatggagtctcgctctatcgcccaggctggagtgtagtggcgtgatgttggctcactgcagtctctgccttctgggttcaagcgattctcctgcctcaacctcctgaatagctgggattacaggtgcgtgccaccacacctggctaatttttgtatttttagtagagacgggggtttcaccatgttggccaggctggtctcgaactcctgacctcaggtgatccacccgccgtggcctcccaaagtgctgggattacagatgtgagccaccgcacctggccagagatgaggtcttgctgtattgcccagggcgttgaactcctgggctccagcaatcctcccacctcagcttcccacgtagctgggactgtgggtgcacgccatcatgcctagccgttttgtgaactgttgaccaatgctcttttctgcagacagaaagttcactgtggttaggagttaagacttttaacctctgacctcaagtgatctgcccaccttgacctcccaaagtgctgggattacaggtgtgagccatcacgcctggtcaaaaatatctttctttaagagtaaatttaccttaacttactggttgatcattgtatataggtctgttgttaattgaaacatgcgggccgggcccggtggctcatgcctgtaatcccagcactttgggaggccgaggcgggtggatcacaaggtcaggagatcgagaccatcctggctaacacggtgaaaccccgtctctactaaaaatactaaaaattaaccgggtgtggtggcgggcgcctgtaatcccagctactcgggaggctgaggcaggagaatggcgtgaacccgggaggcggagcttgcagtgagccgagatcgtgccactgcactccagcctgggcaacagagcgagactctgtctcaaaataaataaataaataaataaataattgaaacatgcggtgcatgtgtttatttgcgatctgacttgtttggaaatatttgcattatcttccttctagatttagagcatcttgacagtaggaacaagtgttttgtacaactttgtatgcttagtaagttatcaattaacttgtcgtggccaggcgcagtggctcacgactgtaatcccagcactttgggaggccgaggcgggcagatcacctgaggtcaggagttcgagaccagcgtggccaacgtggtgaaaccctgggtttgtttgtttgtttatttatttatttattttttggagacggagtctcgctctgtcgcccaggctggagtgcagtggcgtgatctcggctcactgcaacctccgactcccaggttcatgccattctcctgcctcagcctcccaagtagctgggactacaggagcccgccaccatgcctggctaatttttttatttttagtagagatggggtttcgccgtgttatctgggatggtctcgaactcctgactttgtgatccgcccgcctcggcctcccaaagttctgggattacaggcgtgagccaccacacctggcctaccctgtgtttattacaaatacacaaattggccatttgtgcgtggctcatctacagtctcagtgactcagaaggctgaggcaggagaatctcttgaacccgggaggcagaggttgcagtgagcagagatcgtgccactgtacttcagcctgggtgacagagtgagactgtgtctcaaaataataataataatttgttgaatatgtgactgttggtttaatttttatttttatgagatggagtctcactctgttgcccaggttggagtacagtggcgtgcagtggcgcaatcttagctcactgcaacctccgcctcctgtgttcaggtgattcagcctcccaagtacctgagactacagacgtgcactaccgtgcctgactaatttttgtatttttagtagaaatggggtttcaccatgttggtcagcctggtctcaaactcctattctcaagtgatccgcctacctcgaccttccaaagtggcggaattataggtgtgagccgtggtgcccggccagactattggtttggtttggtgtgatgttatgttatgttatgttatgttatgttatgttatgttatgttatgttattttaagacagagtttgtctcttgtcgcccaggctggagtgcagcggcatgatctcggcttactgcaacctccgcctcccaggttcaagtgattctcctgtcttagcctcccaagtagctgggattacaggcgcccaccaccgtgcctggctaatttttgtatttttagtagagacagggtttcaccatcttggccaggctgttctggaactcctgacctcatgatccacccgccttggcctcccaaagtgctgggattacaggcgtgagccactgcgcctggctgactattggttttattattaagcagtagtagttgaccctgtcatgtagaaagcatggcatttataggcataccacgtttaatttcctcccctttttttatttttggagtacctcctgcttgtgaggcttgggaatacagtagtgaataagccagatgaggtctctctctttttggagcttatgtggtagtatagactaggcagaaagttctcattgcccctgccaccttatggcattgaggtgtttgagatgctgatgtttacttctgtctcataaaatcttgaaaggagttcttttagatgaagaggaaaacaaaatcagaagaatgggcctgggtcatgtctgtaaacctccccacgtcatggggaggctgaaatgggaagggccaggagttcaagaccaggctgagaaacataacaagaccccatctctacaaaaaatattttttaattaatgggggatggcagcacacacctgtagtcgcagctactacgaggctgaagcgagaggattgcttgagctcaggagttaaagattgcaggagctatgatcacagcactgcgctccagcccctcttatcagcagtctggtatgttgctaagggtcttgttctttttagtgcttcagggacagccactggctatgcccagaaataagtatgtttgagaagctttctgacctcagcttgaaaaattgattagggtcataattaaaaagggagggaaacaggattgagtgaaccggacgctaccgtgagtttattctcccagggcatacataatctcatgtgattaccacatagccctgttagataatctgttatcctgtcctcattttacccatgaggaaatgaaggcccagagaggttaaatgacctattcaaattcactcagaaggtggcagagatgagttactatcattgtattttggatctctggaaagaaagaaaactagtgatggtattaaaaaatgttattaatagtttcttttaatcaaccaggaacttgagtcactagcttctctgggtgaaggactatacttcaacagtatgaaaaacggaaaagaaaatgaggaattttggctgggcacagtggctcacacctgtaattctagcactttgggaagccaagggaggagggtcgcttgagctcaggaattcaagatcagcctaggcaacatagtgaggccccatctctacaaaaataaattagctgggcatggtggtgcatgcgtatagtctcagctacttgggaggctgactcaggagggtcacttaaacccaggaattggaggttgcagtgagctatgattgcgccactgtataccatcccaggcgacagagtgagaccctatccccccaccgccaaaaaaaagaaaagaaaatgaggaatttacatttgtgacagatacggaattcagggaatttagttgttcatagtctataaatgctataagaagtctccatacctttttttttttttttttttttttttggagacagagtcttgctctgtcgcccaggctggagtgcagtggtgcgatcttggctcactacaagctctgcctctcgggttcacgccattctcctgcctccacctcccgagtagctgggactacaggtgcccgccaccacgcccggctaatttttttgtatttttggtagagatgaggtttcactgtgttagccacagatcccgacctcatgatctgtctgcctcagcctcccaaagtgctgggattgcaggcttgaatcaccgcacccggccggaagtctccatactttttaacccaatctaaaatggtaaggaaatatataagaatgtctatttattattaaattttttctatataaaacatttcagaaaataaagactagcatttctgagccaagtggtagtagtggccattttttctggaaaaaaaaaaaaaaagaaagaaaaaacacatttagctatctatgatgtgaaaagatgaacattttatttaggtaataaatgttatgtcataaaataccatttattgtgtgcctattaggtttcaggagagctgtgccaagagcattacttgtatatcttttaagccttacaacagcccagcctgtcaggctggtagtgccatatctgttttacagatgaggaagtgatggattggagaaattaaggaaattgcctttaggtcaaagagataggaagtgacaaagctgagatttttaaccttgtgagatttcaaagtctttgctttttaataactgttccattgcttctaatatagagatatgacaaaaacaagtaaaaatcagtgaagaaggctgggagcagtcgcttatgcctgtaatcccagcagtttgggaggccgaggcgtgtggatcgcctgaggtcaggaatttgagaccagcctggccaacatgacaaaactccgtctctactaaaaatacaaaaaagttagccaggcgtggtgacaagcacctgtaatcccagctactcagtaggctgaggcaaggagaatcgcttgaacctgggaggtggaggttgcagtgagctgagatcgctccattgcactccagcgtaggcaacaaagcaagactccgtctcaaaaaataaataaataaataaataaaaataataacaataatgaagaaaacaatccggtgattattgtcagcaataaaatttcttcaatcaaccatgctttagtcctggcagttctctatcagtgagtttcaatcaaaaagtttgtttataatttttttttttttaaaattttgaaatttggaaacaacatcataaatgatggttagttttctgcagctccctattttggcagatagtctgttgttactcataattaatttgaactaaaaagtagtgttgtacgatatcatgggctgtgaatgtgtttgtgacttgatctgagaacccacacaccacttaggatgcttctgtaggaaaattagagtatggaactcacttgcccacgctttccctgtctcagtccatgttggtaggctgcaaagtctggggctagaaggacactgaacaagacttcagcagtacatgttagtcttccagagggaaggaatataatagttgagagaataattcctttcctctgtgactttaggcaaattcttggctatgctgttatttatttgggccaaacaatatcaggaggttgtacattttattcttaattactgcgatacattaattttatccatgggtttaacctagcctaccttttgctgttagacttcaactctacttgtgttgggttacccctctgcttaaaaatcaccctattcccaagcctgagggagtctaccttcaaagctttctatgacctaatccaaggcctgtcaaacttcgtaaagggccagatagtaaatttgttttttttttttgagatggagttttgctcttgtcacccaggctggagtgcaatggtgccatcttggctcactgcaacctctgcctcccaggttcaagtgattctcctgcctcagcctctcaagtagctggggttataggcatgtgccaccacgctcggctaatttctttgtatttagtagagatgggggtttcaccattttggtcaggctggtctcgaactcctgacctcaggtgatccacctgctgcggcctcccaaagtgctgggattaccagtgtgaaccaccgtgcccagcccgatagtaaatattttaggctttgcagtccatatacagtcccatttttttgtgtatgtttgcacgttttctttacatattttaaaagcccctttttttttttttttgagacagagtcttgctgtgttgctcaggctggagtgcagtggtgcaatcttggctcactgcaacctctgcctcctgggttcaggcgattctcctgtctcagcttcccgagtaactgggattacaggcacatgctgccacgcccagctaatttttgtatttttagtaaagatggggtttcgccacattggccaggctggtctcctgatctcaggtgatctgcccacctctgcctcccaaagtgctgggattacaggtgtgagccaccgtgcctgacctaaaagctctttacagtgtaaaaaatattctgagctttaagccatgtgaaaataggccatgggcatttgctgacccctaatagaactccattttacctttctgatcatgtttcccattaactcttcaaaaatatgacctccatttaaatcaagatggtctccttcctcactgcttgtggaggtccagtgcccagtgtctgcctcttgcttgctcctccatcattgttctgccattcgagatcctcatacttaccctttaagatctagcccaaattttccatgaaactaattctaataattaaaaacttcctgtagaacttaactttgtctagtacaagttagctttcttattcagtagtagcttactataaattacaagaataaaaagattaccattttccctcacactgttttgtggagaatgcctaaagttactttttctttttacaggtcagtattcctatttggcatcctaatcccctttcccaaatctgaattttgggatttgaagcttgcatttgagattatgatttgtcttccttgttgtacacaggagcagggactttacaattagtattcgcatccctgctccttcatacttcgtgatgtaaggcaagttattttcacttatgcttaagtttcttcccctgtaaaaaggggatggaagaggattaaatgaattaaacatgtaacacgcttaaagcaatgcctggcaagtaataagtgctcagtaacttttagctgttcttattagcatgtttggaaaccagtagaaactacaccagcaagttaaggttgaaaagtggtattgatgggcttggggtagtacagtatgaatggctacagtttagcgtttcattaagtttgtatattcattaattcattacacatttgatgctgtcagactaggacagagacaaagatgaatgaaacattatctctgcttccaggttacccagtgtagtagagaaggcaggcatgcagatagtttaaattggtagcactgggaggggactgccatgggtgggcagtgaagaaaaagggcttcaaaataatgagagttgagatggatcttcaaggaagataagcagttttcagtaaggccatgaagagaggaggaagttccaggcgggaagagtttgtgctaaagtacagggattgctatacacatggtgtatgtagaaaaaatttggttcacagtgtgatagaagaattggagggggtcctcactgaaagtaaggaaacacatttggaagaatatgtttcagttagaaaatgaaatgagcttaaagtaaacgctaataaggtttttaaaatgtaaaatttcaacgtatttagaaagagaacagctggatgaatcttatgtacctgtcactcagctttagcagttatcagtaaatggccaacgttgtttcagctatactcccctctcctccactgatagtcttttgaaggggaatacaattgttttgtggcctccagaaagggataagtttatgagcaacgggtagatcgttgggagagacttgagtttcctgtcaggaagcattcttggtgcataagtcagaggtgatatgaatgccgtggaagggggtggcttactgtctggagaactcgagaagatgggaatgggcactgtccagtattgtggctacttccacacatggttctttaaatttaaaattatgttgattaaaatttaaatatttcagttcctcagccatactaatcgtatttcaagtgcttagctgccacatgtgcctaatggctgcaatattggacagcatgacataggacatcttcatcattgtacaaagttctcttggacagcatgggactagagccctaagatccttttctacctgagttgtttggattttttggtgtgtctaggttggatctagttgttcatggcttcatgaccaagccttttatccctttctctagagggactcaaggggtaaaggcactgaaggggtaaaacttcatatgaagagtgtggtggtggtggtggtgttttaagacagggtctcgctctgtcactcaggctggagtccagtggcatgatcctggctcactgcagcctcgacttcctgggcttaagtgatcctcccacctcagctcccaagtaactggaactgtaggcatgagccaccacacctgcctaatttttaaaactttctgtagagacgagatttcgccatgttgtccaggctggtctcaaattcctggactcaccttggcctcccagagtgctgggattgcaggtgtgggccactgcgactggccttttttttctcctttactactctagtgtatgctggaatatgaggaaataattatattagctagcagttattaaacacttaataacataccaggcactgttttaagctatgcgatctgtatggaatattacttaatttccacaaccttatgaaaagatactattttttttcttttgagaaggtactattttcatcttcatttcatagatgttgaaattgaaacacagagagctgaagtcacaggattaaggccacagagctgagaagtgatggagccggaatttgaacccaagcaattaatgctgatattagttcttgtgtgaatggtaattgttttgaaacaatgatcctagatgattatatgaccggattaatctggcagttgttctgtgtgaatttagagttgccttcccacctcagtttcctaaaaacaaaacaaaacaaaacaaaacaaaaaaaactctagcttcactgtgtttgggttgtcatggcctaccccctcttgccacctcatttgactcaactttttagggagaaaatattcaatacgtggtataggatttccctttctaataataatgtaaacaacaacaagaagtctgaaattggaagaacaaaatgactcacctaagtgagttaaccttaagaggtggaacttgatttctagattttagttaattgtctaactgatgtactaaatattagttacttaagtattaaaacgggtagacataatagttggggagctgctgtagagggggtagtttgagaaggcttctttcaggaggtgacatttaagttggtaactaacaagaaaggggcagccatgtgaatagctggagggaagagcattcttacagttttactggaagggggttagaggtatgtggtacccttatgccaaagaaaattagttacttctatacaaccagtctgattctagaaacctggatcaatgaaatattttgattatataaaaaaatctgttacccaggtcttgttgaaatagcattagaaactactgaaggacatatagaggaggagtgttgaaaaatggtgatggatgagcagaatggtgaaaaataaaaagacatgaagctctataattatattgtatggtgacagtaccaatagagattgcatgttttttctccccagtttttttttttgttttgttttttgtttttgagacagagtctcactgtgtcactcaggctggagtgcattgtcgtgatattggcttactgcaacctctgcttcctgggttcaagcgattctcctgcctcagcctcctgagtagctgggattacaggcatgtgccaccacgcccggctaatttttgtatttttatttgagaggggatttcaccatgttggcaaggctggtcttgagttcctgacctcagataatccacctgcctcagcctcccaaagtgccgggattacaggtgtgagccactgcgcccggcctcccccagttgttgaaacaataatggaaggtaattttattcttagattatttaatgtttttcagttatcaggatgtgttagattgtttgtgtatattgttttgcttgttaattaagtaacacagtgaataagacagacaaacatacgaaaatgtacatttattttatttttttgagacagtctgttgcccaggctggagtgcagtggcccaatctcggcccactgcaacctctgcctcctgagttgaagcgattctcttgtgtcagcctcatgagtagctggggccatgggtgcacgccaccatacccggctaatttttatatttttagtagagatggggtttcaccatattggccaggctggtctcgaattcctgacctcaggtgatctgcccgccttggtctcccaaagtgctgggactacaggcatgagccactgtgccaggccatttcatttttggaacgttcttttttttttttgaaatggggtctcgctctgtctcccaggctggagtgcagtggctcaatctcagcttactgcaacctctgccttccgggttcaagtgattctcctgcctcagcctcctgagtatctgggactacaggtgcatgccaccacgccaggctaatttttgtatttttagtagagacggggtttcaccatattggtgaggctggtcttgaactcctggcttcgtgatctgcccgcctcaacttcgcaaagtgctgggattacaagtgtgagccaccacgcccggcctgtttctggaatattcataatcttttgttgtcatttcaacagtgctcacagcagcttcaccaggtgtagattccatcttaagaaaccactttctttgcttatccatgagaagcaacacctcatctattcaagttttatcatgagattgcagcaattcagttacatcttctgaccccacttctaattttagttctcttgcttttttaccacatctgcagttacttgctctactgaagtcctgaacccctcaaaatcattcatgagtattagaagcaatttcctggttgggcacggtggctcatgcctgtaatcccagtactttgggaggccaaggagggcggatcacctgaagtcaggagttcaagaccagtctggcaaacgtggtgaaaccccgtttctactaaaaatacaaaaattagcggggatgtggtggcgggcgcctataatcccagctacttgggagactgaggcaggagaatcgcttgaacctgggaggtggaggttgcagtgagttgagattgtgcccttgcactccagcctgggcaacaggagcgaaactctatcttaaaaaaaaaaaaaaagaaaagcaatttcctctaaaactcctgttaatgttgatgttttaacctcctcccatgctcatggatggcattctcagtggcatctagaatggtgaatactttttagaaagttttcaatttattttgccatcagagaatggctatgaatggcagtagtagccttacagaatgtatttctttttttttttttctttttttttgagatggagttttttttgctcttgtcacccaggctggagtgcagtggcatgctatctcggctcaccgcaacctccgcctcccgggttcaagcaattctcctgcctcagcctcctgagtagctgggattacaggcatgcaccaccatgcccacctaattttgtatttttagtagaggcggggtttctccatgttggtcaggctggtcttgaactcccgatctcaggtgatctgcctgcctcggccttccgaagtgttgagattacaggcgtgagccaccgcgcccggccgtatttcttaaataaaatggcttaaacgtcaaaattatcccttgatccctgggctatggactgattcttgtgttagcagttatgaaaacatttatgtccttgtacattcccatcatagctttttgtcaatgagaagtaattttttttttttttttgagacagaatctcactctgtttcccagcgtggagtgcagtggcatgatctcagctcagtgcatcctacaactctgaggttcaagcaattctcgtgcctcagcttactgagtagctgggattacaggcgcccaccaccacgtctggctaatttttgtatttttagtagagatggggtttcacgatgttggccaggctgggctcgaactcctggcttcaagtgatccacctgccttggcctcccaaagtgctgggattgtaggtgtgagccactatgcctggcctaattggcctaatttcaatattgttatatctcagggaatagagaggcacgaggagaaagagagacaagctgactgctggttcgtggagtagtcataacacacaacatttattaagattgctgtcttatatggaccgtttgtggtgccttaaaagaaatcagggtaacatcaacgattactgattacagattactataacagatacaataataattgtaaattattatttacaattgtaaaatacaatcttttctttattatttacaattattgtaaaatacaatctgattacagattactataacgtatacaataatagtggaaaagtttgaaaatattgtgagatttatgagaatgtgacacaggcgcaaagagagcacatgttactggaaatacggcactaatggacttgcccgactcggggtttccacagacggtcagcttgtcaaaaatgcagcatctgtgaatttcaataaagcaaagcagaataaaatgaggtatgcatgtattgccatcacatgtacactagtaaaatacgttttttttttcagtaggtggatcaacctcaaattttaatataaagcattacttaaaggagaatatggggacattcatgacatttcttatatgtacataaaacttcatgaaaataatttaatgctatccagcagtttattttagaagtactggaggctaggcatggtgtcttatgcctgtaatcccagcactttgggaggctgaggtaggaggatcacttgagttcaggagctggagaccagcttgggcaatatagtgcgaccccatctctacaaaagagaaaagaagtactggagtgttgcagctcttacagaatttgtctagcaggttttccagtctttaccagaaatgcccccatgcagaagtagtaaatactgattcatgtaaaataataaacaactttatctttcagtttttaaaagacagggtcttgtaacgttgcccagactggcctttaattcctgggctcaagcgatcctctcacctgagccttttgagtagctgagactacaggctgcacctctgcacctggctctgcttgatttttaattgttgtattgctgttgcagctatgtttttttttttcttcagtgtgaggatgggcaaactttttatgtaaagtctcaggtaataagtattttaggctctagggccatatagcttctctgttgcatatcctttttttttttttccatttcccctcaaattccttttaccataagcaactcttgaggaacataaaaatcattcttagcccagaagccagaccaaaacaggttgtgggctgtagtgtcctgacccctgatttaaagattgatagctttgaaatggaaagttttaactttctttttttttctttcccttgttctgattgggctgttaattcattaggtatttactcagtgtgtatcatatgaggcatgattcctctgctaattttggtagtggtagaaagatacttttgccaagcttggttgttaggttttcatttgtccaagagttcctgaccaagtgtgaatggatgttgaaatcaaggtgtttctttggccacacaatgtgcctttgggggctatatctatgtgcttctggtaccttcttttaattttcacaaagacactgcttgccgaccacactgttttgtctaatgtggggctatgaccccctggaagaggcatcattttctgattttcacagaagcataatatggtcaggtgatggtcctgagtagtgggtatatgacagatacactagtaattataatacagatctaaactggagagttgaaaacagcatcgtatatttgattgagataatcgaaggaagacttcctgaaaagatggcatttgagtttcaaggctgagtaggattaagtattattatttaaaaaatgccttggacaatgcattaaatagagttaacaaatcacatcacttatagtctccaattaaaaacattttacttaaacataattttagacttttagaaaaattgcaaagatattataaagaattctcctatatatctcacctgtattcttcaagtaacattttaccatattcaccttaacattttctctgtattggtaattgtatatgtaagatttaatataaaataaaaattcttattaaacatatgagagacatgatgcctctttagccctaaatacttcaacttgtatgtactaataacaagggcattctatttcaaaaccacagtacagttgtcaaaataaggaaattaataattgtgtcaaactgttattctgtttatagaccttctaatgtcctttaaaacaatcaacaaatcaacatttttctggtcaagaaccagtaaatatgtatattctacatatatatatacacatatatatacacacatatattctacatatatatgtggaatatacgtatttactccctctgtccaagaaccaatccaggattgttaccttcggttatcatgtatctttggtctcctttaatccaaagcagtttctttgtcttttatgacttgacacttttgaagattacaggttattttgtagactgtccctcaactagggtttatctgaggtttccttatgattagattcagatatttatttttggcaggaatacaacagaaatgatttgtgtgtttttctcattgcatgatatcagaaagtgcattgtatatatttatcccattactggggttgttaactttgatcacttggttagagttgtgtctactaagtttcttcactataaagttatttttcacttggtcatttcatcagtatcttgtggggagttactttgtggttatataaatactctgtttctactttcccttactatatttagcttctgtggacacttttgcctgaaacagttatttactatggtgttaccaagtagtgatgcccttttcttccatcattctgtctacatttttttttttttttttttttttttgagatggagtttcgctcttattgcccaggctggagtgcggtggcctgatcttggctcactgcaacctctgcctcccgggttcaagcagttctcctgcgtcagcctcccgagtagctgggattacagacatgcgccaccactcctggctaattttgtatgttcagtagagacaggatttttccatgttggtcaggctggtctccaactcccgacctcaggtgatccacccacctcagcctcccagagtgctaggattacaggcgtgagctgccacaccaggccttctttttctcttttaagagatagagtcctgctttgtcaccaaggctggagtgcagtggcatgatgatagttcactgcagcctcaaactcctgggctcaagtgaacctcccatctgtagctgggactacaggcacctgcataacacctgactgttttttaaaactattttagagatggggtcttgcgaagttgctcaggatggtcttgaactccgggtcttaagtggtccttctgcctcagcctctggattagttggcattacaggcatgagccattgtacctggcaagtgcatattttctttttttttttttaaggtggagtctcgaggccgggcgcagtggctcacacctgtaatcccagcactttggaaggccgaggtgggtggatcaagaggtcaggagatcgagaccatcctggctaacatggtgaaaccctgtctctactaaaaatacaaaaaattaactgggcatggtggcacacgcctgtagtcccagctactcgggaggctgaggcaggagaattgcttgaacccaggaggtggaggttgcagtgagtcaagatcatgccactgcactccagcctgagcgacagaggtagactctgtctcaaaaaaaacagaaagacggagtcttgctctgtcacccaggctgcattgcagtggcatgaactccgcctcctgagttcaagcaattcttgtgcctcagcctcccaagtagctgggattacagacatgtgccaccacacgtggctaatttttatagttttagtagaggtggagtttcaccatgttggctaggctggtcttgaactcctgacttcaggtgatccacccgccttggcctcttgaagtggtgggattatgagtgtgagccactgtgcccagccaagtgagtatttgcttatgtagtattttaattttatgatttttttttctttgagacggaggtttgctcttgttgcccaagctggagtacagtggtgccatctcggctcactgcagcctccacctcctgggttcaagccgttctcctccctcagccacctcctcctgaatagttgggattataggcgcctgccaccatgcctggctaattttttgtatatctagtagtgatggagtttgagcatgttgccaggctggtcttgaacctctgacctcaggtgatccacctgccttggcctcccaaagtgctgggattaaggcatgagccaccatgcccggccagagactgttcatttattttttttttttgaggcggagtctcgctgtattgcccaggctggagtgcagtggcacaatctcggctcactgcaagctccgcctcccaagttcacaccattgtcctgccttagcctcctgagtagctgggactacaggtgcctgccaccacgcctggctaattttgtttttgtatttttagtagagatggggtttcagcccgccttggcctcctggagtgctgggattacaggcgtgagtcagggcgcctggccaatcataccttcttttactgcattaattatggttttctttcgttcttaaaacatgtttatagtgaccacttttgaaattcttattaagtcagacatctggttatacaagcaatttctattgcctacttctttttccagtgggtggggttatactttcctgtgtcttagcttgtcgtttttttttttgttgttgaaaactggacattttaagtaatgtagtaactctggatacctcattagcctatggttgggggtggtggttgttactgttatttgcttatttgtctaatgactggctgaatgattttagtgttctatccttcttccctccctgtacagtgtgacacgtctgatgctagttttcttgggatgcagccttgggtatgcctaccatcactctagaatcacagtgattttggcatggctttgtctcttttcctgactgtacccagctgttaagctacactaattactaggtgatgctgtgtagtcatttcttggtgtccttgggggattggtcccaggacccccccgttggatataaaaatttatggatgctctagtccctcataaaatggcacagtatttgcatataccggtgcacatcctcctgtatgctttgtcatttctagattacttataatacctaatatggtgtaaacactaggtaaatagttgttatatattttttatttgtcttatttttattgtatttatttttaagtgtttttaatctcgagtgattgaatctgaggatgtgaaatctgcagatatggagggcctgcattgttttccgtggagctttgggcctaaactgctccacagactgatctgatcaaatttgcgcttctttgaagggatagtttctgagatcagtgtttgaaatttgttccaatccacagaggagtcctcccagctctctttccctagttctggccaccaaactagacaactacaatttagcacttatctccaatgattctcctcctaccaagtgcctttgaaagcatcattaactctttcataccttgttgcaaatgaaatttctttgggaagagattgtgagttttttttctcctaaattatggtgcaatataagtaatataccattttaacaattttaagtgtattaagtgttttttttttttgtagtttttttttttttgttttttgagatagtcttgctctgtcgcccaggctggagtgcagtggcacgatctcggctcactggaacctccacttcccgggttcaagtgattctctggtctcagcctccccaaatatctgggattacaggtgtgcaccaccacgcctggctaatttttctatttttagtagaaacggggtttcaccatattggtcaggctggtcttgaacttctgagctcgtgatccacccacctcggcctcccaaagtgctgggattacaggccttagccaccacacctggcctatgcattgcttttatatgtattttaaaattcataagttctcctcctatgatgtttttgtcccatgtgatttatttgttaaaccgtcatctttggccgggcgtggtagctcacgcctgtaatcccagcactttgggaggctgaggtgggtggatcacaaggttaagagatcaagaccatcctggccaacatggtgaaaccccgtctctactaagaatacaaaaattatctgggcatggtgacgcgtacctgtagtcctagctacctgggaggcggaggttgcagtgagccaagatcgtgccactgcactccagcctggcgacagagtgagactctgtctcagaaaaaaaaaaaaacaaaaaactgtcattttttatgttgcatttactgcattctggatttaaactgtgaggaacctcatggtatcagttaatatattcttccatcttaatgtttctcgtaaactggtagatctgtaaacttgattaggtctatcctattgtatcacatcagaagcagaaggtgcttttttttttttttaagggaaattgtgtgaaagtagacagaatggtaaagtgaacccctgcacacctatcacccagctttaatagttatcagctcataccattcttgtttgatttacaaccccattcatttctcccttctgtattattattatttagttaattattttttgagacagggttttgctctgtcaccaatgctggagtgcagtggcataatcacagctcactgctgtcttgacctcctgggctcaagtgatcctcccacctcaccctaccaagtagcggggaccacaggcgtgtgccaccatgcctggctagttttttattttttgtagaaacagggttttgctttgttgcccagactgatctcaaactccggcactcaagtgatcctcctgcctcagcctcctaaagtgctgggattacaagcatgagctaccacattcagcatgtaaatttctttatattaatttgactggcattttaagtcacacttgaatttcatatttggcaactattaaaagcatagagtcctggatattagtgttttgttaaacctgatctatctaatcataaatatacttaggtctaaaatatgctcttggcctttgtttattgcggttcagtatttgttactatattaaatagtaaaatatttggtttgagatactaatgaaaagattaaaagtaaagcataacttgaatggatacaaaaagaaacaagaatttagacttcagtggatttcagagaatactgcttcgatatgctaacattcctgttgggtgtccaaccgtgtcatagatcagtggaaattagtggtttctgcactttactgtactgtttttttatatgataatattttcctggttgaatgattcgttcttttgagtaaactccatggtcaaacaattactttttattagtcaaagatgtaaccacataatcactaaaaagaacagtgtgacttatttaaaggggattatgtttttaagtcttttatatagctttgtagggaggccatatgagtttaaggacagttcgtggcatttgttcaaggttttgtaacttggcatctcagcagccaccaggataccagatcatcgttctaagtaagatttaggcattttagccttcatgtacagactataagtacacccccccacacccctaccaaaactgtaaattcaaatgatgtttgaaaaagcatagaatttttgttaggcgaggtagtttattccttgtgatacagttccagagaggcagcataacctaggaatgaaaaacttagacgtggaatcagatacacctggtttaaataccagctctactgctcatgaactggatgattttggtcaagatacttgactgctgaggttcagtttcctcacctgtaaagtagaggtgatagattagacatgttgcatgtgaagtacttagtatggtgtctggttttgtagtaagatctataaaagataaattattagtcatattccttagacttcaggaatttatctctgtgccatgtttgaggcaaacagttacagaattagaatgttagaaatgaaaggaatcctagatgtcatttaattcaagtccattgttttctggatgagagaagaaagtgaggaaaagtgacagagttggagaccaagctaggactggcctcagaatgttaagagtactcttctagggatcgaccagtcgtgttactagactttttggatctgaattgtgcttttccttgaatgttttgaattttggcttgagtgttgtgattattttattaaaatgagattccagtcctattgtcatgactaatgtttatgagaaatataacatttcactttaatgatgttttttaattattctaaggggcctaatctttttcagtggaataagctttaggttgtattatattctataattcacttgaaaatagaattcatctttacttgacagccaaattttgtgtactgcatcttttctgagggagagagttggcaaggaaaggcacttgttacaacgatccacacatatagacgcatattatttagaaatgaaagtgctttgaatgatttagcttattttcagtttttttttttctgcagttgtaatcatatgacctgtttttctttctttttttttttttgagacagagtcttgctctgtcaccccggctggagtacaatggggcggtctcagctcactgcaacctccacctcccaggttcaggcgattcttctgcctcagcctccctagtagctgggactacaggcgcatgccaccacacctggctaatttttttattcttagtagagatggggtttcactgtgttagccaggatggtctcgaactcctgaccttgtgatctgcccacctctgcctcccaaagtgctgggattacaggcatgagccactgcgcccggcccatatgacctgtttttcttttatagatgggggagaaatatgggaagtgacttggtgtcagtcatctgtgttggttaaatcaagaatataatccgtgttttgcttctgaatagctctttataacagtgattggttactttgggagtaaagattattatttagagacagagtcttgctttgtcgcccaggctagactgcagtggaatgatcgtagcctactgcagcctcagactcctggactctggtgatcctgcctcagcctcctgagtagctaggactagaggtgcatgccacatgcctggctataattattattaatttacgtttagcattagtttttttcttccagtaggctattttactttatttatttgattttgatgaagtttgattatttctagtttgcttccttctatgacccctacctgttgtgggtctccaggcaagcagtgcataggtagagccatccttaggtagcctttagacttaatattaggtgagctctccccacagatagcctctcctttatttgaatggaattatattttaagtttggaaatatttttcagcttatttagcctgttgaatttaataaaaataatatttaatcttttcagaggtcgaaacagtaacaaaggactgcctcagtctacggtgagtaactttaatgttacttattggggaaaattagtagctaaaacatgatctctaaccacagaccaaatgccaaggcaaaagattcccttcttttgaattttgtcatagataacttgactgtttaagtatgttattagcctatatgtgtttttttaatgactctgtataaaatgtacaattacttgttgtattagtccattcttacactgctaataaagatatacctaagactgggtaatttataaaggaaagaggtttaattgactcatgctctgcattgctggggaggcctcaggaaacttacaatcatggtggaaggggaagcaaacacatccttcttcacatagcgacaggagagagaagtgctgagcaaagcagggaaagccccttataaaaccatcagatctcctgagaactcactcactatcatgagagcagcgtaggggaaactgcccccatgattcagttatctccacctggtcttgcccttgacacacgagaattattataattaaagataagatttgggtggggacacagaaccaaaccatatcatttgtaaatagtatttttgtcacgtgtaataacaagaacaagtcgcttgttcttttctaaatgactaagtgcaaatctaagtgaaaaacctccaaaagatacgtagaacaccaagagtggagtctgcagagttctttatgctttttattttgaattaatgtgctttttttctgctgctttcatttttctcctttggctttctggtcttaaattttggaatgttatcaatgaaattgaaccggacatgaagggcagaaactataagtcccacatgatggaagaaataaatgagaagctatcacaaatttttgagactttgcctttattagattgttttacaagaatcaggaagatatacacgtatatggtagtaatatggagtagtgtggttgatcagacttaagcactgtcactgatgctgatatgctgggagaacctagtcagggttcttctatgaaggtatgacctggcttcctaccccatttatttatacttcacccttcttagggtacatttctgtgagttttaacaattgcatacaatcagtgtaactaccaccacaatcaagttaatagaacagtttcattgcccaccaaaatccctcaaatcacttttcagtgaaccctcctctctctccaaccattgatttgtcttccatccttacggtttgtgtccttcctcctctatggaagtttactcttgcttttttatgtcatgtttagtcaaaacaccattagttggtttgactgataacacttgaaaacctgaccttctgttccttctgttctctatggaagcaaaatattaaataaacaaaatcttcccttaatacatgtaagatatcataaacctaactaaacattttgcaacaaataataaacgttagctttatatgcaaatgtaaatacaggctgagcatccctaatcggaaatgctccaaaatttcatattttgaattagggatgttcaagcactaagtataatgcaaatatccccaaatccgaaaaaaatccgcagtctaaaatacttctggtcccaagcattttagatgaggaagattcagtttgtactaatttctaatagttttttttttttttaatattccagatttcttttgatggaatctatgcaaatatgaggatggttcatatacttacatcagttgttgtaagttattagattattggggataaactgccttgggggtagaataaagtaattccatgaagttaaaatgtggataaatgattgtcaaagtaacattgcttagatcatgtttagtcaggatgatttagagaaatagattagaactccttttatccagtctaatataattcattgtaaaagtacagttggtcctctgcatctgtgggttccatattcatggattcagccaaccttggatcaaaaatatttgttaaaaaggccaggcacagtgactcacgcctgtaatcccagcactttgggagtttgaggtgggcagatggcttgagctcacaagtttaagaccagcctgggcaacatggcagaactccgtctctacaaaaagtaaaaaaactagccgaacgtggtggtacgtgcctgtagtcctagtgacttgggaggctgacgtgggaggattgtttgagcctgggaggtggaggtttcactgagctgagataatgcccctgcactcagcctggtcaacagtgccagacagaccccttctcaaaaaaaaaaattttttttttttttttttttttttttttttttgagaaaaaagaggcatggttgcgtctgaaccaaagatgtacggacgtttttcttgtcattattcctaaaacaatacagtatgacaatttacatagcatttacattatattaggtattacaagtaatttagggatagtttaaagtatttgggagaatgtgcttagttatatgcaaatactattacattttatgtaagtgacttaagtattatgtaattcggtatctgaaggaggtcctggaaccagtcccctaccaataacaacagatagctgtattcttgttaaccctgctgtgtgtgtaaaataatgttagtagttgattgtcttttgtacattattttgtcacttaaaatagctggggtcagaaatgtttgacttcagtattaaaattcgtactgcaaactctgagtagagcctcctgaagaatttcaagagttcagtgtattgttaatgttttgaaatttttttattgttttgttagtgaatacctaatattgaatgaagcctgatgaggtataaaaagtaaaatgaaaacaaatatccctggtgaccgggtagtatactgtttctttgataaataaattatatgtttttagggctccaaatgtgaagtacaagtgaaaaatggaggtatatatgaaggagtttttaaaacttacagtccgaaggtaatttttactttttttctttttcttacaaagtaaaagaacattttcatagtcagtgttttacctagtttttaaagccactttgaatgattttacttctcagtttcaaatactgattattttatagactggtttgtgtaatcagagaggcttcttgatgtgtgtgcttattaaaatatttcaaccatttttaagcattgtgagctaatagagggatgtggtggtttgttttttcctcttaaaaattattattaatgtacttaagacaaaccatagaaacaaaaaacatttagatatgaggatttttaaatgatggaatggataatagatcatatgcctgggaaaaagggtatgattctcttgagattatttttgtcaaaggcatataagaactggtaccttgatgagctaaagaattcctaacaaattttattttgtaaaggtttggagtacttacttgtgtttttcattttagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagaggtgggttttgatttcctaaatatgcctcatggtttattagatttattcaagcaaagattttcacagtgatcttacaaactttttttaaagaaatatctgggctgggtatggcggctcattcctgtaatcttagcacttagggaggctgaggcgggtggatcacctgaggtcaggagttcgagaccagcctggccaacatggcgaaaccccgtctctactaaaaatacaaaaatttatttttgtgtgtggtggcgtgcgcctatagtcctagctactagggaggctgagacagaattgcttgaacccaggaggcagaggttgcagtgagctgataccgcaccactgcactccagcctgggtgacagagcaagactccgtttcaaaaaaaaaaagaaagaaaaaagaaatatctactttctagaatagcccaagtaaggtaattttttagaaaaatgagaatgttaatgcatttttgttggaaaacaattagaactttagagaaaaattaaatagagtttttgtgatctcttaaaaaattagtttgtaaagcattttctacagttttgtggtcaagaatgctactgattatattcaactgaaaatttcttgtcccatttggcctacaatgctttagtttataagtgggcatgtggcaaatctggaaagaaatcaaagtataaggctaaggaagaaaggtagagaacggttggtagaaaacaattgtctaatgaaaatgaaaaagggtgaagaagtagaacatacgtattttaaaaatattcagagtatgagacaaggttttgagaatttaaaagcgattatgtagttatattaaaaatttagtctctttttaagtgtccattgatgaacaaagtgggaattcctgttactcatttgcaaggcattattgagtgttcagtaacacgttgcaaggcacttctgggcaatcctgaacttggttctcaaattctttttttttttttttttgagacggagtcttgttctgtcccctgggtggagtgcagtggcacgatctcggctcactgcagcctctgcctcccaggttcaagcgattctcctgcctcagcctcctgagtagctgggactacaggcgtgtgccaccacaccaagctaatttttgtattttttgtagagacagggtttcaccatgttggccaggatggtctcgattgtttgacctcgtgatccgcccgcctcggcctcccaaagtgctggaattacaggcatgagccactgcacccagccggttctaaaattcttttatttatttgtatatgccaaattctgtagtgaaatacgtaattctgttgtaaattgtagttcagtacaatttgattttcactattcaaatctataccaaaagctgtttttattgttgggctgattcttctacactgttacttggaaataataatataccaggattctttctcttagacttaggagtctttctctttgcttgctttttcagaggctaacagtactgggtattctttaactgtcttgatatgctgatgaaagcacagtgttctgtttttgaatcttctcaaatgtccttgtctttgattcacaactttttgtcttaagaggccttcagcatcccatacaaggaaacaagtctttttttagctgctacctttggagttgattttgtttatgtctaggagcactaaattatttatacttatactattgaaatattcctctgttataaattcaaaaattgactttggaagataaaattttagttgaatttaatacatagcactctggaaagagtattggccacaacaaaaaaaaaggttccctactctattggataccaggtcatttaacagccatttacggtatgcattgtctttttgtttttatgatgaattgatatttcccaaatgtggaagagtgaatattactttgagatgtttgtgatagtccattccttgctcctcttcaaaattaatgtcattaaatttttattactttattagatcttcatttctcagataattttagttcattatagaaaggcaagaaaatacagatcagagtgacaactttgaaaatctcactctactcataaggggatgggtgtattttgctatatattacaaaattagttttcttgatgaggacatccactattggagtaatttcaggtatcttattttttcttttctctctctttttttttttttttttggagacggagtttcgctctgttgcccaggctggagtgcagtggcctgatctcggctcaccgcaacctctgcctcctgggttcaagcgattctcttgcctcagcctcccgagtagctggttactgaggcatgtgccaccatgcccggctaatttttgtatttttagtagagacggggtttcactatgttggccaggctggtcttgaactcctgaccttgtgatcctcctgccttggcctcccagagtgctgggattataggcgtgagccaccacgcctgggcaggtatcttatttcaaaacttacagtggtttagtgaattatacaattgcgtccagtgcgtagtatcctgaaaatagtattaagtcatgtgtttaggacatcaggtctcttaagctaagactatccaggcagaaattgccctcttctataaaagaagaaaagtattaattaggaagtactatcagtatggagaaaaccattttagaattattaattggcatggtttccttctttttttttttatttcgagatggagtctcactctatttcccaggctggagtgcagtggtgcgatctcggctcactgcaacctctgcctcctgggtttaagcgattctcctgcctcagcctcccgagtagctgggattataggcacataccaccatgccctgctaatttttttttttgtttgtattcttagtacagactgggtttcaccatgttggccaggccgcatggttttccttaataacaaaattaaggcatttattactgcatctagattttttttattttttattagagacttactcagattactcccaaagtaaaggaaggtatggtttaatcaatgcttcttaatgctgggttcacgtttagtcacctggggagtttttaaaaatgttctcacttctagggatcctggtttaattataattagcctgggtgaggctctggacagtcagggtgtgagctatgggtttcatgtgatgagatcccaggagtggctctgttctgtggccttgagaatttgtgctttctaggccaggtgcggtggctcactcctgtaatctcactttgggagaccaaggtgggcagatcatttgaggtcaggagttcgagaccagcctggccaacatgttgaaaccccgtctttactaaaaaagtaaaaaattagcgggacgtgatggcacatgtctataatcccagctacttggggagaggctgaggcagaagaatcgcttgaacccgggaggcagagattgcgagatcatgccactgcactccagcctgggcaacagaataaaaaaagaatttgtgctttattttcttgcctcacagtcccctttctgtctcagaattggcaactgcctgaaatagtctctgctgttatcatttgatagtacttttccacatcttgaatggatagatagagtgttttttataatagaagtggatgaatgattagagtatactaatatgacattgtattttcctaaaagatatgaattgatttcatttctgagcttttataattctcttctgtaatagtctgtcaaattattaaggttgataatattaactaaaatttgagtgcatattctatgtgccagactctgtgctaacagatttacctacatttgttcacataatcatcacaagttgtttctgtagtagatacagctattatccacgtcatagatgaggaaacaggcatatttaggaaacttgctaaagtgaggacacaaatctagcttttctactctaactcatgttcttaacattatactgcagtgacataaattatgtggtttggtttgttgtttatctcagttgtcataagtcgaattaatgtttgtttgtttgttttgagacagagtcttgctctgtcgcccaggctgggtacagtggcgtgatcttggcgcactgcaacctccacctcctgggttcaagcagttatcttgcttcagcctccctaataactgggattacaggcacgtaccaccacacccgggtaatttttgtatttttagtagagatggggttttaccatgttggccaggctgatttcaagctcctgaccttaggtgatccacccacctgggcctcccaaattgctgggattgtaggcatgaaccactgtgcccagccagtaagttccatggttgttaaaggatttctccacaaataaagctaaaagtaaaaaaaaaaaaaaaaaaaaaaaattctcaagcaatataagatgcagactattatgttgttcaagttttttttttttttttttaatctttggctttatttttggggaaaccttttttttcttttttgttttccttgggacggagttttgctcttgtcgcccaggctggagtgcaatggtgcaatcttcgctcactgcaacctccgccttctgggttcaagcgattctcctatctcagcctcccgagtagctgggattacaggcatgtgccaccatgcccggctaactttgtatttttagtagagactgggtttctccacgttggtcaggctggtcttgaactcctgacctcaggtgatccacctgcctaggcctcccaaagtgctgggatcacaagcgtgagccaccgcgcccagccagggaaacctttattttgaggcggagtctcgctctgtcacccaggctggagtgcagtggcgtgatctcagctcactgcaacctctgcttcctaggttcaagcaattcttctgcctaagcctcccgaggagctgggattataggcgtctgccaccatgcccagctaatttttatatttttagtagagacggggtttcaccatattggccaggctcttctcaaattcctgacctcatgatccacccaccttggcctcccaaagtgctaggattacaggcgtgagccaccacactcggctgctggggaaaccttttaacatgagtaaggtcagtgtgacttttaagttcttgatgctaacatcattgatttcaataaagtttaaaagttatattcatgcatatatgcaaatgaataaaaggctttgaaatagtgacttcttacggtacagtgaataagtttcctttggtctcttgaatgttatacatgttccagtttgatttactgagaaactgaaagtacctttacgtcatatgagctgtgagtcaccttggcacattcataattagaagagaccatcagattatcattggaaaatcagtttgtatttatcctttatttgaattccagtgcagacagatctgaggttctcttcattttgctaaaacttcttagggccttcagtcgcttttggctctgtattcgtgtatctttggaattgtcctgttatctctgcttgttttttacttgattttccatccatttccagtattcctttctcctctatttttttccttcattttctttctgctcttcctgttgcgccattattcatgttttcctctttactccaactcaactatggctttacttctgtttccttattccattgttcctcatactttttcctactgcttcattttctttgcagtattctcagcctagatgataggggtcagcaaatctgctcatcagtaaataaattttattgtagcatagctatgcccatgcgtttgtgcattgtctatggctgttttgatggctgtagccatagagttgagtagttgtagctgactgtaggacttgcaaagccagaaaatttgactgtctctttacagaaaagtttgccagctcttggcctaaatcatattttccgctgcatttagggctttttaggactgatcaaaaatacatgctatactggctttggtgaagtaacagaatgtgctctgtcctttaaacttacaactaattgcatgctttgattctaatactgtataatatcctgcgattcttattcatgaccattctaattggatttagtctgaagaattacttttgcttaacagattctttgtcacatttagtgaaaaatcataaaaggggaaggttggttaatggaaaagatctccatcaactaaccactaccttccttatctacaaatttatcttcttcctccgtgccatctttttttttttttttttcagatgatcttgctctgttgcccaggctggagtgcagtgatgcaatcacagctcactgcagcctcgacttcccaggctcaggtgatcctctcacctcaacctcctacataactgggactgtatgtgcacatcactatgcctgactaattttttatatttatattttttgtagagatggggtttccctgtattgcacaggctggtctcaaactgctgggcctaagagtcttcccaccttggcctcccaaagtcctgggattacatgagtcaccgcacccggcctcattattatttttcctctggttttagtagagaggatttttaagccaacttcaatcatgcccttgactctctcccttctacttacctccttgttctctttttctttttctttttttttagatggagtctcggtctgtcacccaggctgaagtgcagtggcgtgatttcagctcactgcagcctcagcctcctgagtagctggggctataggtgcctgccaccacgcccggctaatttttgtatttttagtagagatggggtttcaccatgttggccaggctggtctcgaactcctgacctcaagtgatcacctgcctcagcctcccaaagtgctgggattacaggcgtgagccaccacgcctggccatctttttttttctccttgctcttttataccacttctctgtttctgggctcttcaacatctgcctttctagttaatctttccctttagcatgaaaacctattcacttcctgctcatcctaaaaaggattcttttttgttttgttttgtttttgtttttgagacagagtctcgctcttgcccaggctggagtgcagtggcactatcttggctcactgcaagctccgcctcccgggttcacgccattctcctgcctcagcctcccgagtagctgggactacaggcacctgccaccacgcccagctaaatttttgtatttttagtagagatggggtttcaccgtgttagctaggatggtctcgatctcctgaccttgtgatccatctgcctcggcctcccaaagtgctgggattacaggcatgagccaccgcactgggcccaaaaggattctttttaatcctgaattcttctagccattatcctgcctaaggctacgattaacctctaactgccaggtcctttggaatctttttctgtctttattgctgcacttgaatgttggtttcaccctccttcagaatttcctcttctgtattttttatgtttattgatcattccttccctgcctcattcctgggcttcttttccttcacacaccccttagatgtgtgtccccagtgtttgtttctttgcctgctgctcttgccacatgacacacactgccagctaccacacacaagttccctcctatcatgtgtgtatcattgcccttataccatgttgtattaaaattatatgcttgtctcccctgttacagtttgagctctttgtgctccaagtaaagacagtgatactgtctttattatttattctcatggtctagtatagtgctttggcacatagtacaggctcaatataaatgtgtttgaataaatgaaattcagtgccttaatacacttttgtagaagcattattttatggaaagaatgaaaaagctgtaagtggtcttacatatatagtcatccagcagatacttagagagctctgggatgtgttccttgctgtgcttgttgctatggacagtacggagaaatacaagaatctattttgggtcccttttgagaacctagtgaaactgtgtacctagtgaaactgtataccctcaccctagaaaaatttacacacatgtagattttacatgtaattcttttaaaaattaattttttttcttttttttaaagaaacagggtcatgctctgtcactcaggctggaatgcagtggtgtgatcatggcttactgtagcctcgacctcctggctcaagcgactctcccacctcagcctcccaagtagctggggctacaggtgcacgccgctatgcccggctaatttttaaaaatattttatagacactggttctcactatgtttcccaggctggcctttacctcctgggttcaagcaatcctctaccttggccttcaaaagtgatgggattataggtgcaagccactgtgcccacgctaatgtaatttcatggtgttcacagtttcttcagggagttcatatacgccatgtactctattctaagcatttttagagttagagatagcaaagcacgtgaataaattcaagaaaaatggaatgttgtactgcatgacattgaatatcaaatggagtcagcgatgcaaataattgtctagattttacaaaaaaaattagcctggtgtgctggtgtgcgcctctaatcccagctactcgggaggctgagacaggagaatcatttgaacccagaaggtggaggttgcaatgagctgagatcgtaccactgcactccagcctgagtgacagagcgagactccatctcaaaaataaaaaataaaagaattgtgtagattttagtagttggaagaagttggagtgttaatgtgtaattagagaacagtgagaaataaaattctacagattgttttattctggtgtgctgttgtgttctcatatggttgtctttttggtcttgatagtgtatcagtaacagagtacgagtaacaaacagggatctcttctgaacggcgtgacattagaaaagctgtttacggcctcaactttgctgtggtttattaagacacagatatgtgttcattctggggccaagcagtaactggagagtggcacttattgaggccagtatggaggcagtacagagattattgagattaaaagaaagaaacaggtggaacggatctatgtaatggaaagctaaacagaatagttcgtggtacacagtagaaaagcattacatgtttattaagatatggtcatcttccatttattaaagttacatgttttataatttttagagtatatagaaattctctaccctatcatgtttgccaaagtcagaacaataacttcatttattaaatataaaaaaaataaaaacctctagcataaaatagaattttatttggacaaacgataaaaaaatactgtgtggtactagtaagagtaaggttgattcaagatacatgggagcagaatccaaagtgtagaaataggccaggtgcagtggctcatgcctgtaatttcaacacttttggaggctgaggcgggaggatgagttcaggagttcaagactcgccttggcaacttggcaaaaccccatctctacaaaaagtacaaaaattagccgggtgtggtggtgtactcctgtaaacccagctacttggtgggctgaggtgagaggttcacttgcagccagtaagtcaaggctgcagtgagctgtggttatgccacggcactccagctgggtgacaagcaagaccttgtctcaaaaacaaaccagccaggcgtggcggatcacctgaggtaaggagttggagaccagcctggccgacatggctctactaaaaatacaaaaattagctgggcgaggtgacgggcacctgtaatcccagctacttgggaggctgaggcaggagaatcgcttgaatccaggagacggagtttgcaatgagccgagatggtggtgctgcactccagcctgggtgacagagccagactctgtctcaaaaacaaaaataagcataggacatggggataaattgaagatttatgaagacacagctgaaggagacataaaagtagatttggctaaatggaaacatgccatactttgaatggaattatttaatactacaacgttgtcaattttcctcaaataaatctctaaagataatatattcagttttggccgggcacgttggctcacgcctgtaatcccagcactttggaaggctgaggtgggccgatcacttgaggacgggagtttgagaccagcctggccaacatggtgaaaccctgtctctactaaaaatacaaaaatcatctggacatggtggcaggtaccagctacttgggaagctgaggcaggagaattactcgaaccccgtaggtggaggttgcagtgagctgagattgcactccagccgggtgactccatctcaaaaaaaaaaaaatttttataatatatatatatatatccgtttttgtagaaattgacaaaatgattctaaagcttattagattatgtgtattaacagaagaactttggaaatttttttccacaagagtcataaaggaggacttgccctacaaaatatgtcagaattaaaacataacttgtcagctgggtgcggtggctcacgcctataattccagcactttgggaggctgaggcaggcagatcatgaccagcctgaccaacatggagaaaccccgtctctactaaaaatacaaaattagccggtcatggtggcgcatacctgtagtcccagctactcgggaggctgaggcaggagaatcgcttgaactcgggaggtggaggttgcagtgagccgagatcgcgccattgcactccagcctgggcaacaagagtaaaactctgtttcaaaaaaaaaaaaaaaaaaaaaagaattataactgtcacagtggctacgtatggagcatccaaaactgaatttatgtgggtattttattaatatgcaatatagcactttaattctggaggaaaggtggattattcagtaaatgattctgggacattggggacaaattagatacctacttcacactgataaataaaaccaaatagattaatgagaaaactgtgattaaacaaaacaacacccagactacactggagcaaatctgtgaatttgtttaattttgagtggagaaggactttataagcatgactaccagagcaaaaaaatcatgaagtaaaagatcgatacctttgattataaagagattaaagatttaggccgggtgtggtgctcacgcttgtaatcccagcactttgggaggccaaagcgggtggatcacttgaggtcaggagtttgagaccaacctggtcaacctggtgaaaccccatctctactaaaaatacaaaaaaattagtcaggcatggtagcacatgcctgtaatcccagctactcaggaggctaaggcaggagaattgcttgaatttgggaagtggaggttgcagtgagccgagattgtgccacatcactccagcttgggcgacagagtgactccatctcaaaaaaaaaaaaaaaaaagacttagacgtgtccaaaagtaccatacatttaaaaagacatgccacaaactgggaaaagtagaaaaatagttttaaaaatgaccagtgaatgtatgaaaaggtggccctcctcacttgtaatgatttaagaaatgcagtttatttttattttattgtatttttaaagaaattcagttttaaagcagtggaatatgattgtctatcagcttgcgctgaatggtaaatgtgagaaagattactactacttagtggtactgagggagttgcaaaacacttaacactgctagtgggatggtttaagtaaaacaagtagcattcttaaactctctattaggtaaagaataggtaagtaatgcatatgtttccaggacattttcagtaagactgtttactgatagggttgtgtaatgctaatatacttactatctagttttagtattatttttttctcttgtcttggatggtttcaatggagtcttatgcatgcagatatattaaaactagtaataaagcaagagaaggaatgtggataaattatctctaatttctattttgttctatttctatttcatactcctgggaaagaatattaagtgggcatgtgtacttgaacagttgttctgttttttattagaaaagaatccgaatctataaaatgttttacatatttgccagggaaacagaaaagatatttgtacagctgtaagaattggaattaatttcattttactgacttttccttaacctaattctgaacacttttgccataggtttgagaataagttgttataaaatgactactattcttcactaatagtattggcatttcaattcctaaattctgttttttgattcttgaacatttctgaatttactttttttgtcttagttcttctacagaatcattttcttcttttttctttttttatttttattttttatttttgagacagagtcttgctctgttgcccaggctggagtgcagtagcgcgatctcggctcactgcaagctccgcctcccgggttcatgccattttctcctgcctcagcctcccgggtagctgggactagaggtacccgccacagcgcccggctaattttttgtatttttagtagagacggggtttcaccgtgttagccaaggtggtctcaatctcctgacctcgtgatccatccgcctcggcctcccaaagtgctgggattacaggcatgagccatcgcacccggccttctttttttctttctctttaacttctgagctgaaaatagtaccttttataaagaagtgctcaaacgatgattggactgatttctccttatttctctctttctctctgtctctttcactctctttttagaatttttcttttttaagtagagacgaggtcccactatgttgcccaggctgtcttgaactcctgagcccaagcaatcctctttgcctcagcctcccaaagtgctcggattacaggcttaagctatcacaccaggcctaggctaatttcatattttgagatggcacaaatttctttcaggtagctagcttttcctcctcctccccacttaaaatagatcctgatccagaagcctaatggagaaaatgaaaacagaatgttcacccataaacagtatctttgtattggaatcttttctaaaacttcttttgatctttttaggagatagtgtgggaatcagcaatctagtattacgtacgtggaatctgtcaccttgtttttttaaatacagcaaacctcatgaagtgaatttccatattttttcttgttcttgttagttttgcaccactcaggctttgctgtagaatttgatgtatatttgattctgtagagcatgggctattgatcttcactcagctttcagaggaatctgattagtaagtttgagttttttattattttttagttgattttgaagtaaaatacagcaccattttaactgataccatttctaaacaattttcagttcaaattttaagttagctaatttagagcttaagaaaattgctttaaaaacataaaattactggctgggtacagtggctcattcctgtaatctcagcactttgggaggccaaggcagatgaattgcttgagcccagtagttcaagaccagcctgggcaatatggtggaaccccgtttctacaaaaaaaatacaaaaagtagccagacacggtggtatgtacctgtagtcccagctattcgggtggcagaggtgagaggatcatctgagcgcagggagattgaggctgcagtgagccaagtgagaccctggtttcaaaaaaaaaaaggttactaattgcagtgccttttatcttatttaatgggcttagtcaaactaagatgatgtattttatcttataaatgttttcccttgaattttaactgaagaatccaatttgtacctctcacaaacagaatgtattagtaaggaaaataaatactgctttttattacttaaataggatatatttttctcttagggattttttttctattttatctcactttatcgtagtgctagaaaatttaatcattcatttgagatagggagaaaattaggtttttttttttcttctattttgagacagggtctcattttgttgtccaggctggagtgcagtggcgccatcgtagctcaccataacctcaaactcatgggttcaggtgattcaccttagcctcctgattaagctgggactgcagatgtgtatcaccactcctggctaatttttgttgttattttttgtttgatgaggtctcattatgttgcccaggctggtctcaaactctgggcctcaaatgatcctcctgccccagcctcccaaagtgctgggattacaggcatgaacctctgctcccagcccattttttaaaatatattcacagcattgtgcaaccatcactacaatcaatttacattttcatcaccctgaaaagaaactctgaaccccttagcagttcctctctgtttgtttcaattttccccagctccaggcaactattgatttattgtcttcataggtttgcccattctggacattgcgtattaatggaatcatataatatatagcctttttttttcttttttttttttgaaacagagtctcactgtgtcgcccaggctggagcgcagtggcatgattgcagctcactgcatcctctgcctcccaggttgaagcgattctcctgcctcagcctcttgagtagctgggactataggcgcctgccaccacacctactaattttatatttttagtaaagacggggttgcaccatgttggccaggctggtctcgaattcctgacctcaagtgatctgcccacctcggactcccaaagtgctgggattgcagccatgagccaccgcatctggccatatatattatgataggcttgtttcacttagtatgtttcttccatgctgtagcatgtattagtacttctttctttttcatggccaaatattccattatacagttacacaggtacactacattttgtttattcatcagttggtggacattttcattgtttccaccttttgatttatacataatcctgctgcgaacagtgacttttaaagtttttgtgtgggccgggtgtggtggctcatgcctctgtaatcccagcactttgggaggctggggctggcagatcatttgaggccgggagttcgagaccagcctgcccaacatggtgaaaccctgtctctactaaaaatacaaaaatgagctgggtgtggtggcgtgcacctgtaatctcagctactagggaggctgaggcagagaatcacttgaagctgggaagccgaggctacagtgagccgagatcacgccactgcactccagcctgggtgacagagtgaaacttcatctcaaaaaaaaaaaaaaaaaaaaaaaactgcgtgtggacataggttttcaattctcatgggggtgtgtgtgtatgcatactcatacatacatacacatacctgcaagataattgctggctcgtatgctaaatctatgttgaaccttttacataactgttgggctgttttgttttctttttattattttttgaaaatagagttggggtctcactgttgcacaggctgatttcctgggcatagtggctgtatcattttacaatcctacatagctgtttccaacgtagctgtatcattttacaatcctactagcagtgtctgaggtttcttatgtttttcacatcctcaccagcatttgttattgtctgtctctttgattatacccatcctagtgggagagtaagaagtagtatctcactgtagattttttttttctgtttacaactttactttaaaaattatatatgcacacatggtaaaaagttcaaaacgtgtgtaccaaaagatttaacagtgaaaatagaaaataagtgtggtccttgttttcttccaccaaggcaaatattgttataatctcctaaacaacttgtcttccagatttctcattttcagtcaatcttgggcattgacataaagaaattcttagacattgcttttattagatcatctcatcccttgctcaaaatcttcagtggccactgttgtttacagaataaagttgggatgctatacagggcccttcccagtggaacttctctttttcaaccttatctctcattatttcccaatgtttttttttttttttttgagacggagtctcgctctgtcgcccaggctggagtgcagtggcgggatctcggctcactgcaagctccgcctcctgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccacctcggcctcccaaagtgctgggattacaggcgtgagccaccgcgcccggcctatttcccaatgttaatctacttattgacctactaagctggcatgttctgtgtgttagacatcaccaactttgtgccttctttttttgtttgtttttgagttggagtctcactctgttgcccaggttggagtgcagtggcgcgatcttggctcaccacaacctctgcctcccgggttccagtgattctcctgcctgagcctcccgagaagctgagacgacaggcgcgcgccaccatgccctgctaacttttgtatttttagtagagatgggtttcactgtgtttcccaggctggtctcgaactcctgaccttgtgatccacctgccttgggctcccaaattgctgggattacaggcgtgagccaccgcggccccctgtgccttcttcttttactcctggatttaatcccaacgtgaagaatctaccttactaactagagttttagatactttttcaaaaccaagcccacatctgtcctttttagagtcttctctgaccttccctgctcattgtggtttgtttttattgcctgtaacaatggctgttaaactttacattttaaattaatttatgtttgtatgtatttatttgttgagaaagggtctctctctgtcacccctactagaatgcagtggcgccatcatggcttactgcttcctgggctcaagctgttctcccatttcagcctccccatgcaccaccctacctggctaatttttttgtttgttttttttagtttagtttttgtagagacagatgtctcactgtgttgcacaggctgatcttgaactcctgggctcacttgatcctcccatctcagcctccccaagtgctgggattacaggtgtgagtcaccatgcccagactttaacattttctttttagtatagaataggtcagtttttttccctctgatgagatcccatgctgactcttagttaaaacaaggctttggttggaagaagagctagtgatgtcctagctccctacttactccactttcccttgccttctggggtgtcctgaagacatcatagggtgtcatgaagtacagttggagaaccagtggtctccatcatgtaccaaacactcatcttcacgaagcagtatgtagtgtcttttttaccggtatattttctctctcccaatgcattaaacttttctggagttcagaaaacaaatttatagaattaaggaaatgcgtcccccccaaccatggtgtctagtatatatacagtgacttacagataacaggtgttcaacatatatatattcctttgattgatttttgaaaagtttacatgtatatattttttatatacggggtctcactctatcactgaggttggagtgtggtgatgcagatcttggctcaccgcaacctcctcctcccaggctcaagtgattctcccacctcagcctcccgagtacctgggaccacaggtgcgcatcaccatgcctggctaattttttatatttttggtagagacaggattttgccgtgttgcccaggttggtttcgaactcctgagctcaggcagtccacctgccttggcttcccaagtgtgagccaccactgaaatacttatatttttaaacttaatttatttatatttattatatttttatgtttttatattttaaaaaatatttttatactcactagacccaattttatactcctaaaccagggaataactgtttttttttctcttacataggcatgataccatagacaatgattaaaattgtaattaccattcatttcttagttttgtggctgggacactgatgtcttcaaatgttagtttgcaaatacagtcagccctctctatccatgggttacacagctgtgaattcaaccaaccatggatccaaaatatatgggaaatacgctggggctgtgggtcacacctgtaattccagcacttagggaggctgaggcagatggatcacctgaggtcaggagttcaagaccagcctggccaacatggcaaaaccctagctctactataagtacaaaaaattagctggccatggtagtgcacatgtgtaatcccagctactcgagaggttgagacaagcaatttgcttgaacctgagaagtagaggtttccatgagctgagattgtgtcactgcactccagcctgcgcaacagagtgtgagaagaaaagaaaaaaaactgtctgaaaagaaaaaaaaaaattatatgggaaatcaaaagcatctatactgaacatgtacagactttttttcttgtcattattccttaagcagtaccacaactatttccgtagcatttactttgtattaggtattataggtaacctagaggtttaaagtatgcgagagtatgcaaatactacaccactttgtatcagggacttaagcatccctggattttggtatccctagggggtattagaaccaatcccccatagatgctgaaggacaactgtagtgtgtgttggaataatttattttcaaatggatcatttggagaacactattctttaggaaacatagcctcctaagttctgttccatacatccctttcacctccacggcgttgtagcatcctgctttcatgactgtgtcatcactcggaaggaactgcttctcttccagaatgcttttcaagatctactctgaccacagctataaactttacacttctattctcttcttgcccctcacagtgttctctgttcctctaagatcttaaactctgtctactcctaatccagcctgctgggtgtggctggagaaagtcccactggggggctgattagttaggaatgtagggtttccagctcttgctggagcctcagaagagttcagcagacttttttttttttttttttccttaaacctatttctgcagccttgatgaccactccttccagtccctcacctatttgctttattcatggcagaggctctttcttcctgcttgtcagtacaaagaggcaggattcttcacctggatctgtggattctcaaagaatttgtggagagaattcagggcattgatgaccttggatgaagagaaatttacatctttatttacactaaccttcaagtgaaatttagcattttttgccatttaaaaatatgggcaacaaacaactagtagtattagcagtatttatgacttaagcacctatagaactcagttaatttcatatcgcttgatgttatgggtatctcaaattattattttatgtatatatatttttgagatggagtctcgctctgtctcccaggctgagtgcagtggtgcagtctcagcccattgcaacctctgcctcctgggttcaaacgattctcctgcctcagcctcctgagtagctgggattacaggcgcacaccaccacgcctagctaatgtttgtattttcagtagagaaggggtttcaccatattggccaggctggtcaccaactcctgacctcaagtgatccgcctgccttggcttccaaagtgctgggattacaggtgtgagccaccgcacccggcctcaaattatttttagaaacagaatcttgatatggtatccgctctggccttgaacttgtgggctcaggcagtcctcccacctcagcctcctgagtagctgggattataggcatgtgccactgcaccaggcttcaaattattatgtatgttcatcacctctttaaatttataatagttattaaacctgttactggatcttaatatttaatgctttaattaagaacatgtatgttactatgccaacagatttttttagtttttgataactgcatttcattgttacttgttctcatttgatttcctgtgtattttacgaatttaagtacattctgaatacggtttcataggcttccctaaaatattgaaggggcccatggattaagaaaaaggctaagaatccctaatctagaggctccccacagtcctcttttgtcatcatacccctaccccattctagcctgaggagcgtggctccacctgtgcccttggttttgttgttccagtccatacatcctgcacccttaactgtgtttcttatccccaacttgtttctttgtgttattcttcagtattatagtctttaatataatctgtataatacatggtgtagtagtatatgctcgtagtatacaattcagttagaacagatgagtattcaatgaaaagataatctcctctctaacccccagtcccacttccctggggaagcctgtgttcttgtgtacaattcagaaaatgtttatacacatattttttatttatttattttttgagacggagtctcgctctcgccaggttggagtgcagtggcgcaatcttggctcactacaacctccgcctccctagtagttcaagcaattcaaggttcaagcaattcgcctgcctcagcctcccgagtagctgggactataggcgtgtaccaccacgcctacctaatttttgtatttttagtagagacagggtttcaccatgttggccaggatggtctcgatctcttgacctcatgatccacccgcctcagcctcccaaagtgctgggattacagatgtgagccactgtgcccagcctgttgatttaattttaaacagagtttcgctcttgttacccaggctggagtgcaatggtgcgatctcggctcaccgcagcctctgcctcccaggttcaagtgattctcctgcttcagcctcccgagcagctgggattacaggcatgcaccaccatgcacagctatatttagtagagatgggggtttctccatgttggtcaggctggtctcgaactccggacctcaggtgatccgcccgcctcggcctcccaaagtgatgggattacaggcgtcagccactgcaccccgcctatacacatttttttgttttttgtttttttgagatggagtctcgctctgttgtccaggctggagtgcagtggcgcgatctctgctcactgcaagctctgcctccctggttcacaccattctcctgcctcagcctcccgagtagctgggattacaggcgccggccactacgcccatctaactttttgtatttttagtagagatggggtttcaccgtgttaaccaggatggtcttgatctcctgacctcgtgatctgcctgactgggcctcccaaaatgctgagattacaggcgtgagccaccgctcccagctatacacgtatttttaatgccactccagtctatgttggaaccattttacttcccctttcttattttcttcttgtgttcttgaaggcctagatcagctgttgctgataggctgtcactgtcactttagaaagcccagagccttttgttccttagaactttgtttttaattgtattgtagcactcattgtattcgattctaaaagatttgcttcatttctgtaactagtctcttacacccaggagctcctagttcctacaggaaatgctgggaattgtatcagtcaaatgtgaatccccacctcgtccagacttatgagtgcattgtaggtactcagtaagtgctaaaaatgactaaatagtcccactgataccaatctatatactgatactttatatagtatatagattggtccacatataacgatgacacataatgagaaactgtcttaaaaagttgttgaaagtgccgcaggaataggaattgatcaaaacaatatgattttttaggtttatatggaactttgatgtttgagaaaaggctgatttagttgagaagaaatggttagctgaggattttgatgacttctctggaagcacatttgagggtttgtgatgttaaatctgatgttaatgattatttcatccagttttatgtcattttatagtttttatacatttaagtatatttatttctaatgtttaacactaccattttagttatttgaccattattctggccctttaaaaaatgctcagacaagtttgaatgatttttcagaggcattattggctcagaggtaaaagaggaaagattgagaagctgaatatgtactctgtttcctgggtatggggctggggatacccagaagaggttcacacgttggtcgagacatttctttatgaccaccagcaggtggcatcaccggcccaaaatgactaagtttctgcccagaatcagaagagaaggtgttgagagcccactgctgtgggggtagcatggaggtgggatacaggggctggaggtgatacaattttgtttcttcctccaacatcgcctgctagtctagaggcttttataaattgaaaaactaattctttatcatctcatctgatggtttttatgtttttccttttttctctctatacctgtagttccttcagaaacaggtaacacttttctaatagtcacgttgtattcttgcatcttgttgttacaatgcttttgtttctcaccataggggatgatggaaaattaatattctttgacttatggcattggtaaaatctgcatgcaaattcccacagttgcctgtagattagagccagttgtttttttctcaactttgcaggaatcctggttacaacattgtactatttactaccaacagtgttttttttttttaaaatccagacttgctgggcatagtggctcatgcctgtaatctcagcgacttgggaggctgaggtgggaggattgcttgagcccagggctgcagtgattgcggcactacactccagcatgagtgacaaagaccccatctctgaaaaaacaaaaacaaaaacaaattttttttaaagaaacagaaacaaaaatccaaacttgtaaccactgtaaaacaaatcagaatttacgatagtggatattattaatagtgcagaatggatacccagatcttgcttcctttctagctaatgatgcaatgttggcctgaaatgcattacttatagccagggattttctcagcatcctgatgatatagcctcatttcgtgctaactctccacttctgcacatcttcccctaagtcctttactcatctttagaaagagctacttttggtgaaattttaaaaccaaggaatatcattctttatagaatcacacttctgtgttttccccttccccatttctgtctcgaaagcgacagactgctacataacctgtgaatacttttttttaaaaaaagtttggtattgtaaacagaagatttaagattaaaatgtagcattgagaaaaatagatttattaataatgccctcttaacacaacctaaattctggtcagtggaataaagcctgggtcctaaagttttagacgcttgcttgcttttccacactggctcttacttggggatccttttagaaatttgtttagaataatactgtaaaaacatatttaagctactttgtgtgtacatttgggatcttttggtttgaagacggcttgactcaagactttctaaatattttcacacacacacacataccctgtagtgagaaaaaaatccgtttatatggttctataaaaatctctagctgcttcgagctttaatttcttgaatcaaaagagtattgtttttaatactgagcttctatctaaataaatgctttatttacttaaatgtgtgcttttcaaaaactagtatgattaagacattaacaggatcttagacgtaaaggaacagtcctgttgcttcttccagaagataatatgactcgtttggaattttcctatagtgtagttttttgtctagtgttgtgagaattaaagggatttcaggatcttaaggtaggttattatttgatgttttcttggaacattttacattcttgaaaatacacatggctaaattaatttttgccagcaatccacataactttaagataatgtagagaagaacgtgattcaggttagtatcaaataaggtcagatttctagtgccatcagtagctttcagcaaagatgaggtgttggtaagatagcattagtctcttagaatctcttagagagattttccaaaattcagccatttctagtgaatgctccattccacccccagctgagtcctgctgctctggggaactccctcagcacactcttggctcttagaattgctagcaatgggagtagtgctgctggtggagctggcagctaagcccagaggtggattaatgcttttattccctgatgtacaggtacacacactcatacctacccacacctagtttgggataagaagaggttagaattagctaggcttgaagttccatgcttaaatttgctggctcagatttcttattttggcatcactttgcccattagggagacaatgacagttatagaagcattgccaaataaaaaatccatctggaataacctcttttgtaggagtattgtgtgtttagttgttgattcgtcccttcctcctcttagtggcaacttacagtactgggaaggaacagtggctgggagcttatattcctcagcagagccagatcagcagaagtattactccttagttcgtagtaggtggtaccctatgggtccagtcatttaaatgcaagcctgtatctacagagcgtttcctagtgccatcattgcccagtgggcctttatttagctgagtctaactcccaactagagaaaatttcctgtgccagacagcagtatggtcagctaacatgtggatgctacatttgctttcataagtcagtactcttcaataacattagtagaagagaagaggacacaaagtgagagtgtgttaataggaagtccaggtatgcctgctacctgaactttctgagacaggtaatactgtagggcctgaactttgtagcagagtggttatatatgaagaagtgggttctgggaggggttaaaccacttagaatggcttcatttactaatggcaagagtttgctgggatattgaccactgtacatagacatgaatatggaaagttaaaaacaaaatccacatatatttggctgcaagtactccgaaggtatatctaattagtgcatccattaaacaaaagagatattttaggccgggcatggttgctcacacctgtaatcccagcactttgggaggccaaggtgggtggatcacctgaggtcaggagttcgagaccagcctggccaacatggtgaaaccctgtctctgctaaaaatacaaacattagctgggcgtgttggtgggcgcctgtaatcttagctacttgggaggctgaggcaggagattcccttgaacctggaaggtggatgttgcagggagccgagatggtgtcactgcactccggtctgggtgaaagagcaagctccatctcaaaaaagaaaaaaaaaaaaagagatatttttgatggattgatagaaattttctttttctttttttttttgagacagggtctcactctgtcgccaggctggagcacagtggcgtgatctccattcattgcaacctccacctcccgggttcaaacgattctccttcctcagcctcccgagtagctgggactacaggcatgtgccaccatgcccaactaatttttgtatttttagtagagagagggtttcaccatgttggccaggatggtctcgatctcttaacctcatgatccacctgcctgggcctcccaaagtgctggtattacaggcatgagccaccacatctggccagaaattttcttggtcacttctgagacatgcagagtaattacctgtaatataatttaatgaattatgtcaatatattaaaatatgcttcatgtgggctgggcatggtggctcatgcctgtaatcccagcactttgggaggccaaggtgggggtatcactaggtcaggagatcaagaccagcctggctaacacggtgaaaccccgtctactaaaaatacaaaaaattatccgggcgtggtggtacacacctgtagtcccagctactcgggagactgaggcaggagaatcgcttgaacccgggaggcagaggttgcagtgagccgagatcacgccactgcattccagcctgggcaacagaacgagactctatctcaaaaaaaaaaaaaaaatgcttcgtgtggcttaaaattatatgaaaagaaaatacctttactgatagtcatctgtgattccatttgctaaattaaacgtgaaagcatacttttactgaatactatatattccgtatcagtttagatagcagtttatcttcacatacataagttttaagtttacctttattatagtgcattggtcttttgttttcatcaacctaaattatgttcaataaatgtttctgttagattttaagttaaacaattatgtgaaattcatttttcgtaattgttttttaacatatgtctttgttggtaattcacgtgtgtgagtgtaactgattgccagattatataaactttcaaccaaaaccattctttgcagatgcttttactgactctgctatcagtgctaaagtgaatggcgaacacaaagagaaggacctggagccctgggatgcaggtgaactcacagccaatgaggaacttgaggctttggaaaatgacgtagtaagtaacatctttgtaattattgctagactctggtcagtatgacatcctgtcacttggttgtaatttaaatgtgcttttgttgttgttgttattgtagtgagtgtatttagagcagcaggtttgttgtataactagagactttctcccaagcaatatataaagaaaaatgtttgtcattttacttgtaggggttaagcaggagtactgtctgttcttgtggatgctcatgaattacttctttgtgattaaaataaataataagaagtagcttaaattaaaattagaaaccatgggaaatgccggtgtgttttgctttaacacccagccaaataaggtagcctaaggaaagtggtgtcttaattgttgacttcacctagagaagaggttgaagtaggacattttaagcctcttgtctgaagaaaaggttgtcattaagataaataattaggttacattggaattaaagcattacataaatttcttggtcttaaatttggattattctccacaaaattcttttatttctaaaacgcctcttgtcacatactagttttgtttctctctttaatgcattatctgtacttgaagtgcttagctgggtatgctggcacatgcctgcagtcccagctacttgggaggctgaagcaggaggatcacttgagcccaggagttggagtccagcctgaatgacataaggagaccccttctctaagaaataaaaataaaaacaaatacttaataaagactctgtctttaggatagagagcatagagatataaagcaaagtgtcttgccaaaaatgagtgttatggtaccaatatttgagtagaatgaagaatcttccattgagtagaaagagaatttgtaacatatctgtgtttgatgtttaaggcataacagcttaataatgacactcttcctcagacaggaagcctgaaatgtcctactttgacctaaagtctagtaataaaactggacatacacaggcaacatgtcattaattctcaaactttaacaaatcatatataacctaatataatggttctcaagtctgtacatcacgtcacctgtatgaaaaatatgaggaaacagagacttcttttacactattggtgaggtggataaattgatagagtctttctggagagaatctggcaatgctaatcaaaatttaaaatgcacatacactttgttccagcagttctatctctagtaatttatttttgccctcatatatccataagacatgcaaataattatatgtgaagattttttttttttctttttctgcagagacagggttttaccatgttgcccagggtgatctggaactcctgagctcaggtaatccacccacctcagcctcccaaagtgctgggattacaggtgtgagccatcatgcctgaccaggatttttttttttttcagcattatttcttttgttgttgttgctgttgttttgagagatggagtctcactctgtcacccagactggagtgcagtggtgcgatctcggctccctgtaacctccacctcctgggttcaagtgattctactgcctcagctttccaagcagctgggactataggcgtgcgccaccacacccagctaatttttgtatttttagtagagacggggtttcaccatatgttggccaggctggtcttgaactcctgacctcaggtgatctgcccacctcggcctcccaaagtgctgagattataggcgtgaaccaccatgcctggccatagcattatttctaatagtgaaaaattggaaacatgctaagtgtctatcaatatagcatgagttagatttatgatgtcaccattcaattgaaacactacatatctcccaaaaagaatggtgttccaatatggaaagatatctaagatttattaagagaaaaagcacattgcagaacactgggatcctatttgcttttttttttctttttttgagacagagtcttgctctgtcacactgcaacctccgcctcccgggttcaagcgattctcctgcctcagcctcctgagtagctgccaccatgcccagctaatttttgtgtttttagtagagaaggggtttcaccatgtttgtcaggctggtcttgaactcctgaactcgtgatccacctgcctcagcctcccaaagtgctgcgattactggcatgagccaccgcacctggccatgaaatttttttttttttttaaagagctgttcatattcttattgcctagaagatgtctgaaattacacccaagaaactctttttgagacggagtcttgctctgttgtccaggctggagtgcaatggcgtgatcttggctcactgaaacctctgccttccaggttcaagcgattctcctgcttcagccttctgagtagctgggactacaagcgcccgccaccacatctggctaattttttgtatttttagtagagacagggtttcaacatgttggccaggctggtcccgaactcctaatctcaggtgatccacccaccttggcctctcaaagtgctgggattacaggcatgagccactgcgcccggctgaaactctttttttttcttttaagatggagtctcgctctgtcgcccagacttgagtgcagtggtgtgatctcagctcactgcaagctctgcctcccgggttcacaccattctcctgccctagcctcccaagtagctgggactacaggctcccgccaccacacctggctaattttttgtatttttagtagagacagggtttcaccatgttagccagcatggtctcaatctcctgacttcgtgatcctcctgcctcggcctcccaaagtgctgggataccaggcatgagccaccgtgcccggccagaactcttaatagtagttatttatgcacgctgggattggaagacatttactttttactggatgtctttccgtattgtgtgcttttttttttttttttttatgtagggcatacattacttaagtaattttaaagcctccataagtaagtgtgatttcctgcccatgtgtttggcaaaaggaattgcattggtggtagacttacattatagtcttacctggagtagcacaggaggacccaaggttaataggtgaacttcgaggcaagccttagcattgaggttgccatcagcattgcttggttgatgtgttcattcttctgggatggattacaacctttactggactttatacttttcaccagtaaggctttaaaaaaggagttgaaacattagagaataattatccaggcagtaatattcactggtaaatagtcttccagcctgtggcccaattggttgattcttttacgttaaagaatgcagcctcagctgctctgcctatggagtaggattcttttatttactttcttaataaacttgcttgcccctggctcccccccaccaaaaaaagaaggcagcctcccttttgcgaatggtaatttcctatagtttcctcgtagaattgtggagttacctatgctgaggttataggttagggtattgagatccagagttgccacttctgaggtgtcacaactgctaatggtaaaaccatttctaaagcccagttcttgtgactttgtccagtgattgcctgttcaccgtttcatgctgccttcccatttgagcattcccaggaggaaggggaggttgccagggacctagtaccatagtccgaccttggaatcgttgaatatgagggaaagcgttggcttctcccttctttctcccaaacattggaagtatttttggctgttaaaaagcaccccttgttccatgtggaatcccttgtttaaaagaagtaaaatatgtacctcctgtcctccacagacctgaggaccagtgtgatctcaagaaggttacaggtaaatgtagatgtctctaactgaaaggtggcttttacaggttagagaaaagagagaaccctgatctgaaggctattttatgaagtaattaaaatgttctaaactttaaaaataactgctcaaataattgtgttgtatagttacttatcaactggaggggctgataagtatttttctaaaacatttttaaggaaattttttcctattttctaatttgctaattttgctcaagtagtttgttagatattgttaatatagatgttggttataactgaatgaaagggaacaactactttgacattttgaaaaacaagcttcattttcttctagtctaatggatgggatcccaatgatatgtttcgatataatgaagaaaattatggtgtagtgtctacgtatgatagcagtttatcttcgtatacgtaagtttgaaaagtttgtttttattttagtgcatttgtctttgattttcatcagcttaatttatgatgaataaatgtttgttagtttttaagttaaacaattacatgaaataatttttctcttattaccaactgtgataaatttccattaaaaaaagggaataaatgtagtttgcctataccctgtttttatgctctaaacaaattttggttttgtctttttttttcttttgagagggaatctcgctgtgtctccaggctggagtgcagtggtgcaatctcggctcactgcaacctctgcatcccgggttcaagcgattctcctgcctcagcctcccgagtagctgggactataggcgcgtgctaccatgcccatctaatttctgtatttttagtagagacggggtttcaccatgttggccaggatagtctcgatctcttcacctcgtgatccacctgcctcggcctcccaaagtgctgggattacaggtgtgagccactgtgcctggccggttttgtcttctaagttgttaaaaaatatctaaatttgcaagggcagagattatggtgaacagtttaaccagtttttgaaatatgttcctctggagaaaaggtaacagaaaaaaaagttagaattttgatttataaatacacagatcactataacttttagttttagttttagttttagtttctgtttttaccagtattctaaactctaaactttcttagtagttgattatgacagatacataaactgtggctttaaaggactcattttgcttttcttttcctcatgtttcagagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactaggtatttaaaggaaatcatgatgcagtattttggatacacaactcaaggtctgtgtgagacggtgtattgttattatatttcctcttcctttaatatagcttaggtagagaatgcaagtagaattggtttaagatctgttagagaaaaggttatggtgatcttggaaaatatgcttttgagagtaagctctgtggagccaagtgttggtatatcacggtgagcaatccaagatcttgaagagcttgttaaaatagttatctggtgggggacacgtgtaacaatcacagcagtacaatatgatttgcttggttaaaggcatgttcaaagtactaggaacatacagaatgaggaggagctagcataacctgtagagtcagagaaaacctcattgaggaggtgacattttgtgataagataatagggtctttgacacttagagaagagttgggagaagagtttatcacctgatgaaaagccatgtacaagcatggctatgagaaaatttggccagctcaggagagggctggttgttgcatgtgtctggaacacaggatctgtgtcaggtgcagcagtggcagttgatagtaggaactgaggtcattaaaggacttggcatgtcatgctaaagagcaccctgttggaaggagatggggtgaataaaccctggggcattgaggactggctgagacacagagaacagttagtgcactgaaatagttcaactgtgagaatttggtaaccacctagttaagggatgagcctgaggtttatttgataactaagtgacttaatggatgtactggtaagagagagaggaaacatggagcaagtttgaggggaaaaacagtgactccgtttgtgcagctaattgcatatgtgggcttgtgggtctttcatttattcataaacgtgttgagaaatacctgctacctatctagtaaagtaagagatgcatcctctcttaaaggcagtcagcttagagtctggtgatttgaattgacatgtccactgatagatgttgacactgtgagactggcggttcagtttgaggtttcatcagcattgccgatattggagccatgaaaaaccaaagaacagccagtgagagaagagatctcagagaaaataaaattgagaaagtgaaggacaaaaaatgttgtgaagatagaccaagattgatggaatcagccatagagaggtcaagtgggatgagaatgagcacgcatctgttaaactttgtgcttaggagcagaatctaagggaagggacagtccagaggttagaactcagggtaagatggaagaacaggggcatctgggagtgaggcagtttggtttagtgtagaacctttttgtaacaagcattcccttctgtctagatgacttttagatatgtttcattggcttggtaccttttagaataaaatgatttagaggatctctcattttcagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggcaagtattttgaccagacttgtcaatatcattgataaaatagttttctaaatacttaaaatacttaaaatagtttacataactgatatgaatgtgcactttaatgatttggtgagtagctttcacttcagcattacttaaaattggcttttgtggatattaaattagtaaaacattgtatatgtcattgacatatatattatttagcatgatgaaatattcatgatgtactaagataaagtgctacatttaacccaagacaatcacttggccaaaaacacttcacatataaagaaattggaaactttgggtaggttctcaattttaaaaacactggataataaaattttttagacataatttatatggaaaattctaacctatgtgcaacactgtggttaatatagatcaattttcattatttgtttctatattatgcttacttcaagaaaggatctgaggtaacttataatacaagacatgatcaagagtcatgtgaagaaagtgactagagaaatttgcttaaaaaacaacaaaaacaacccttagtctaagggtggatgttacagtttagcaacttaagtaaaagaaacctgaatctttagtaggaagacattttttactctacctctaaatctaggttgaatatatcttgtaggttgtggatcttttccataaatcagggatactgaacaacagttctatggatggtatggaaatagtaatagcaatagtatgttactaactttgtgggaaaagagtggacattcaattttagctatttaaatttggaaagttagatgaaaatagagaacactaagtttccaatttcatttgttttcattgagtcttttctccagaattcctctccaaatggacactcttgagtattttcagtacttaatattgggggtgaaatttctttgctcactgaggaaagattttagttgtttataaacagaattttaaagttaaaaaacctgaagggggctgagaaatatatgatacttaagtgtgtggaaccctatggagaggagacctggactgtttgataagattaaggtaagtgatatgtaatgttaaatactagctgtatctttacctaggcatatccatcagtataaatttatttggtgatgactgctttgtagttgcagtatttattaagcagtcgcttagataagtgtttaactgtataaattatttagaaggtctccctttttctagtttaatgaggtcaagactttttttttgaaatagcaatgaatattatcatttgatactcacaggagtcacaaactctagaagagtaatgttttatttctacttaaatgggacttgcttaataagattccaaactgagttctgggttcaagtgtaaacctgatgaaaatcatagataattgtaaggaaccagcatttctaattggatataatagctactgcttattttcgttatgcctcagagttaaaactaatacagtaaataatcttactcctgagtaggaattattgtgatttattatgtgaaattatctagtgtatgttatattcctttaaacaaccagttactgagaaacagttatagaagcaggattaataggcaaagtcttaactgtcttcttcaatagtgtgtatagatcctaattaaccctttgggaacgtgtattcatttaaacagacttaatcttaaggaggttaaagtaaaatgtgaatttatgtcagttaagttatgctaaaacttatcacaaatcaaatgactgtcctcaaagggttaaaatgtacaagaaatcatttttgtcattttactttttttctgtttacttttttccctcatttttttctttagtttttatactttccttcatatcatttgttctgtcaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaaggtacaataccacaatttgttcatgtttttgtttgtctttgtttaactcctatgtgagtttataattacaaaatagtttcctcttcattatttaataacctataatttctgtgttttaactttagtttattaaaactatttctattaaccttttgttcattagagagaaatttgataaatgtgtgaagctataaactctcttgaattgttgttaaaaagggggtttatctctgcctgataattatgcttctttacagccccagaagggtctgccccacagccttccccctccttatttgcactgtatacagtagttaaacaaatgaactttcttcagccagtcttgaacttaggttcattttacagctctttggccaaggtcctagtgaaccttcctattggccataagcagggatggtgttttctgggtcttttttgagagcgacagcccatgtagctgactttgcgtgtctgcccttagattaaagtagttgatttttagaatgccagaagaattctaaatttaactgagtaatttttttaaagttagctttgcaatcttacatagtgaaaggctgctttaatctggaagaagtccttgatctgagataaaattgataaaaacgacatatgaatttgaatatttagctatttctttcctcgtcaaaaataagaataaaatcttgtaattcttattcagtatttggcgctaaatccatcattgccacatatcaaatacagggatatgttgtagaaaggtaacattctaatttaaatgccacccatatattaaaaacctgttttctgaatcataatgtccttttgatactagttctgaatatttgtgttaaaattttaatctgatttgttcattaaaattagttaatattgcttatgttgggactaataaagttttccgcacaaaatgtgtttctcctgcttccctggagaaaactgtattggctacttttaaataaattgttaccatctaagcaggcaggtcatatgactttgactgaagcatctaaccttgaagagcaagttccactgattttcaaggtgacttctttgctcaaaagggccttaatagtggtcactaaatgcaaaattctgttgatatttttcttgtagtccatcatttgagtaagcgatgtttatttaatgagaatatattaaataaaacatgatcattaatgactgtgaacatctttattacattaagatttaaggactgctcatgtattaacttcacacagaaatatactttctgtgtcattcagagatgttgaatatttccatttgaaaattatagtgtataacattagcattcttctaaagatcatgttcgtgtttaaattcctgttggaagccaggcatggtggctaacgcctgtaatctcagcactttgggaggctgaggcaggtggatcacttgaggtcaggagtttgagaccagcctggccaacatggtgaaacctcgtctctactaaaaatacccagctacttgggaggctgaggcaggagaatcacttgaacctgggaggcagaggttgcagtgagttgagatcgtaccactgcactccagcctgggcgacagagacagactctgtcttataaaaataaaaataaaataataattctattggcaacatatattaatttgaagttctaaagagtttggcagccgggtgagagagtgaggagatttggctttgacattagggaagttttcgcttggtgttaacaccagtaggcttctctgatgagggccattctgtccactcttttacctgatagattggtctaatgcacagtagactgatttagaaagagtagtcactagtggcatggcagaatcaataatgtagaattttgacaattcatatagtgctgatttctcccccaaatgtcagttattttggtcatctattaatagactaatacaagtcatccctttaatagaattttcagctcacagcctgctaagcctaagaaactgcttacaggttactgcttactgttttaagccgagttttaaaattgatgatcatgatagaagagataaataaactaaaattttagagaaatttaagaagggtatgtacatatgttttagtggtatcggggtgtatagggattaatagtcttctgtttaaattttttttttctaattttagaagtaatgtagaaaattcgggtcagggaaaggtaaaatatatggaaagttaaaaatattttatcatgtagtcataatttctagtaacatatttctttacaaataagacatagttgaaacagattgctacagttcttttaagagttgacatcttattgttgatttcttaccaccaacttcatccctccctttctttaaaaataaagggaaataataaaatttatttataaaactttgtggcattccacaaaataattctgaaagaattagtatggccaaaaaaatatgtatggtgttttttttttttctatttttaaccaaggaaaaactgtagagtgagtgagtgtgtgtgcatgtgtgtgtgaatgggtgtatttagcagaaaagtagtactgatgaatatcatggaatttatgtgatgttcactgtttcttccttagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtgggggtaggtaacacttgggcataatgatggtactcattttgtcattacactagatataaagagggctgagctacaactctgtttgaggaagtgtaagtatgtatatgttaaaaatagtagaatcaccaggaattgggaaacccatatttttattctgggctctaccacttattcatcatatattaaagcaagtcagacactcattctgaagttgagatttcgcagtgagtaaagtgttaataattcttgcctagtctacattatgggattgtgatgagattcctataaggttcataaatacagatatattgtaaaactataaagttttgtaaagtacctctctaatatgaggcaaacacagtatgtaacactatttggagggaccgtatttccttatctttttagcagctttgtttatcagtacattctataaacatttatttttggcttacattgtagtgtgtttctatagcatctgtatatggcactaattcccaactatatttccataataaggaatatcaaatacaaataaagggtccaagttttatttgtgattagcataaggaatatgctgacagcagctataaaagtataaaaattaggctgggtgtggtggctcacgcctgtaatcccagcactttgggaggctgaggtgggcggatcacaaggtcaggagatcgagaccatcctggctaacacggtgaaaccccgtccctactaaaagtacaaaaaaaattagccgggcatggtggcgggtgcctgtagtcccagctacttgggaggctgaggcaggagaatggcatgaactcgggaagcggagcttgcagttagctgagatcacgccattgcactccagcatgggcaacagagcaagactctgtctcaaaaaaaaaaaaaaaaaaaaagtttaaaaactagacgttgacatgattttacaataaggctgactgcttttgctactttgccaatcagtccttagtgctttgttcccataactgtggtaagcaagagcttacaaagaatacttaaaacaaacaaacaaacaaacaaaaaaaacactttttctcttttaatcagtccagagaacctttaaaagaaacaagatcggccagttgctgtggctcatgcctgtaatcccagcactttgggaggctgaggtgggtggatcacttgaggtcaggagttcaagactggcctgaccaacatgatgaaaccccatctctactaaaaatacaaaattagctgagtgtggtggctatttgagaggctgaggcaggagaatcatttgaacccaggaggtgaaggttgcagtgagccaagatcacaccattgcactccagtctgggtgacaagagcgaaactctatctcaaaaaaaagaaaaaagaaacaagatcttcaagcttaaggaaacaaaaacaaaactcagctgtgttaaatctgtttttagttgctatacatttctgctcagcttcatgtgatgcacattcatgtaattgtatcctaaattcctttgtactttttattttcttccttggtcttcaattatcttaagactaccaagaaaacaaaaattttaaaaatcttcttcagccggtcaggcgcagtggctcacggctgtaatcccagcacttggggaggctgaggcgggtggatcacgaggtcaggagttcaacaccagcctggccaacatggtgaaacgtcgtctctactaaaaatacaaaaattagctgggcattgtggcgcgttcttgtaatcccagctgctcaggaggctgaggcaggagaattgcttgaaccaggacccgggaggtgtaggttgcggtgagcggagatcgcgccactgcactccagcctgggctatagagtgagactccatttcaaaaaaaaaaaaaaaaatctgcttcagctattctgttaatcttttgacattacttagatggtctggaaataaattttgagaataacatgattagaagtgagagagtataagcatagttttggagatacactcagaatagcattatagattttctctttttactaattggaaaaatggcagttgttgaataatagttttcttccgtgacccttgtgacttaaaaaaaaaaaaacactgaaatgaaataatcgaaccattttctctaaacctttgaatctgagctctgcagttaggtttataatggtatatgaaacctattagatatatacttggaagtcatatgggatacaaaccctgcttttattatcttccccttttgactaacttgggtctcaagtttccttaattactgcacagtggaccttgatgttgctataaagaatgtgtagggctgggcatggtggctcatgcctgtaatcccagcactttgggaggccaaggtaggcagatcacctgaggtcaggagtttgagaccagcctggccagcatggtgaaaccccgtctctactaaaaatacaaaaaaattagctggttgtggtggcgagtgcctttaatcccagctactccagaggctgaggcaggagaatcacttgatacatttagttaggagagaaaatcatacttatgttagtaattgctgctgttcttcatatacttgtggttttgattgccagcaaattcctaacattttggaaaagaaaacagtaatgggataaagggtaagggctagagaggacagttttatttacctagatcttcagagaagcctgaagcctcttttaggaagtaacatttgaactgagaatgtaataaatacattttccctttcttctagttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgagggtatgtaacaaagggcttctggatccataatctcagctgtgaaattgaatgttagagggtgatattatatgaaaaaattctaggttatttttattcatagacaagtatttttagtgcacatttaaaagtttatgtaaattttgatgttgtttaatactactaatttaatatagtgtctgtgttacaaaggttaacattcctgggtgtcaaatacctacataaataaaattattggtgtttcatatgacatctgcaaaggaaaaaaagcctctgtttaaatgaaagcattattttccaaaaacataggaaatcaaaattattgttcagtgttttcttgttttgcttttctaacttatctgaattttttttaaaaaattgttttctagctaaagattccaggcttcaagatcagaggcagaactctcctgcagggaataaagaaaatattaaacccaatgaaacatcacctagcttctcaaaagctgaaaacaaaggttagagtttaaagagtcattaagcttaactgtaggaataggaagaagtatgtctaatttcatgcccatacagaatatttttgttcaacatttcttcttactattgtgatagataaatgtattgcttgacaaattccaaaatccaaatttaatatttgaaattattttctgatcttatatcttattctaatttctatcatctcatactaaaaagaatgtgatgttaaagtttaaaaataaacctgtgtcttaacagttcttaattttacaggtatatcaccagttgtttctgaacatagaaaacagattgatgatttaaagaaatttaagaatgattttagggtaagtattgtactaactgatgaatttgagttttagaaaataagcattactaaagatttatctatttataaaaatgcgttatgtatacagtcagaaacatcaaaccatatatgtagaaagcagaacatttttaaagtggtctttgcctatcctttaagtgggataactaaaatcatgagatttggtaacaacaatatgtaggtatcaaatgagagtatagccctgacatttgaaaccaccatagcacagcttactatttgatggtcatttgtactttgttcagtgaagctagatattagtagagcaaggccaagtcattaataatctagtgtggcaaatggaagatgtactggactctggtgttctgaggtagttggagatttatactttgtacacaaatatattgtggtcaaaatctttctgtaacattatttctctgtcttagcacaggctttacttaacatctctccttgattgtcatttcattcttttgcatgttatttactataggtatcgaggtagattttgagaccaaccaataaatcttcttgaaacttagcttcttagaaaggaaaatctaaataccagccttttaaaaaaagtagctgaattaaaggatgagtgaaccaaaggcaaaggtagcctttcctcagcctgtgttttagctttctaaatgttaacaatagcttcattcttgacttattggtaacattcaaaatactacttattatttcatactttagcacatgtatctattcagctttaatgctattaacagttgttaacctaagttttcatttgttggcgggcacggtggctcacacctgtaatcctagcactttgggaggccgaggtgggcagatcacctaaggtcaggagttcgagaccagcctggtcaacatggtgaaaccctgtcttgaccaaaaatagaaaaattagctaggcatggtggcgcacacttgtaatcccagctacttggcaggctgaggcaggataatcgcttgaacccaggagacagaggttgcagtgagccgagatcacaccactccactccatcctgggcgacagagcaagactgcatctcaaaaaaaaaaaaaaaaaaaaaaagtttttcaatttgttaaacaatagttaacacatacaaatgatacaaagaatattgaatatgatcatgtgcccactacccagcttagtaaataaagcattctaacacagttaaactcctcttatgtatctgcccctcctcagctgcttccccctgtttccttccaaaaggaagggtttcttttctgtgcagttctttatatttatactgcatatgaatatatctgtgagcaatagatgatattttgcataatcttaaatttgctataaagtcttttttttttttttaattgatcattcttgggtgtttctcgcagagggggatttggcagggtcataggacaatagtggagggaaggtcagcagataaaaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtgacacagcacatgtttcagagagcacagggttgggggtaaggtcatagatcaacaggatcccaaggcagaagaatctttcttagtacagaacaaaatgaaaagtctaccatgtctacttctttctccacagacgcagcaaccatccgatttctcaatcttttccccacctttcccccttttctattccacaaagccgccattgtcatcatggcccgttctcaataagctgttgggtacacctcccagacggggtggtggccgggcagaggggctcctcacttcccagaaggggcggccgggcagaggtgccccccacctcccggacggggcggctggctgggcgggggctgaccccccacctccctcccggatggggcggctggccgggcgggggctgacccccacctccctcccggacgggttggctgccgggtggagatgctcctcacttcccagacggggtggctgccaggcggaggggcttctcacttctcagacggggcggctgccgggcagaggggctcctcacttctcagacggggcggccaggcagagacgctcctcacctcccagacggggtcgcggccgggcagaggcgctcctcacatcccagacggggcagcggggcagaggcgctccccacatctcagacgacgggtggccgggcagagacgctcctcacttcctagacgggatggcggccgggaagaggtgctcctcacttcccagactgggcagccgggcagaggggctcctcacatcccagacgatgggtggccaggcagagacgctcctcacttcccagacggggtggcggccgggcagaggctgcaatctcggcactttgggaggccaaggcaggtggctgggaggtggaggttgtagcgagccgagatcacgccactgcactccagcctgggcaccattgagcactgagtgaacgagactccgtctgcaatcccggcacctcgggaggccgaggctggcagatcactcgcggttaggagctggagaccagcccggccaacacagcgaaaccccgtctccaccaaaaaaatacgaaaaccagtcaggcgtggcggcgcgggcctgcaatcacaggcactaggcaggctgaggcaggagaatcaggcagggaggttgcagtgagccgagatggcagcagtacagtctagcttcggctcggcatcagagggagaccgtggaaagagagggagagggagaccgtggggagaaggagaaggagggggagggggagggggggagagggagagggacaatgatgtcttgctgtaggtattcttccccatttgaattttttcctcagcattattttttttaacatcattcagtctcctcttatactacacttggattgaatttaatatctcatgaagaaaaaacatttctactttgaagcatgtgaattagcatgtttttataacagctttattgagatataatttacatatataaataaaccgtttaaagtgtataaatcagtggtttttaatgagatataatttacatatataaatcaaccatttaaagtgtataaatcagtggtttttaaaatattcacaatgttgtacaaccgtcttctcagttgattttaaaacatactcttcacccccaaaagaaaccccgtgcccagtttagcagtcgttccacatttgcctccagcccttctctttcccctactcccaaccctaagcaaccgttaatctactttctgtctctatggatgggcttatttggggcaaattccatttcatacaaatggaataataaaatatgtggcttttatgactggcttctttcactcagagtagtgttataaaagttcatccatgttggagcatgtttcagtacttcatttctttttgtgactgactaatattccttgatgtggataataccacattttgtttatccattaatcagtttgtagctatttgtggtgttctcactgtttgactattctgaataacactgccacaaacatgagtgtgcagtttttttctcgtcctatcttttcatttcttttgtgtacctacctaggagttgaattgctgggtcatatggcaactgtgtttaaccttttgaggaactaccaagctatttgccaagatatctacactattttacattcccaccagcagggtatgagggtttctgtttctccacatccttgctaacacttattgtcttgtcttttttgattatagtcatccttgtgggtgtgaagtgttaacctcattgtggctttaatgtgcagttctttcatggctaatgatgttgaacatcttttgtgtttattggccatttatatatcttctttggattgatgtctgttcaaatctttacccattttaaaaattgagttgtctttttattattgggttgtgggagttctttatatattgtgtgtacaagtccctgttagatacatggtttgcaaatgttttctcctgttctgttggttgtctttttactttttcatcccttgaagcacaaaaatttttaattttgatgaagtccaatttatctgattttgaagtaagcttttggtgtcgtatctaagaaaatactgtttcatcaatcattaaggtttattactcttctgggtttttttaagaattacatttagaggtgtgatccatttggagcaactttttttttcttttgacacagaatctcgctcttttgcttaggctggagggcagtggtgcaatcttggctcacagcagcctcagcctcctgggctcaaatgagtagctggtactacaggtgtgcaccaccacaccttgctattaataacttttgtatttttttgtagagacagaatttcgccatgttgcccaggctggtctcaaacacttggactcaagtgacacgcccacctcagcctcccaaagtgaaaaattgctttcaccttgcactgcggactcgccctgaattctttcttgtgcaagatccaagagccctctctgggggtctggatcgggacccctttcctataacaatattatgagaataacatttgattttttttaagtgaaacaaattgttattaaaaaattaaaaaaggtcataggagagtgacttggtgctcagcccattttgagcagttatttaatatagcataaggtggggttcaaattcattctttatattaattttttatttctaattgacacataaccatacacttataaccatttttactgtgtaagttcagattcattcttccgtatgtaggtattagttgtcccagcaccatctgttaaaaagactattcttggccaggcacagtggctctcaacgcctgtaatcccagcactttgggagtcccaagcaggcagatcacatgaggtcaggagttcgaaaccagtctgaccaaatggtgaaaccgcatgtctactaaaaatacaaaaattacctgggtgtggtggcgcacacctgtagtctagtcccactactgtagtggctgaggcaggagattcgcttgaacccaggaggtagaggttgcagtgagctgagatcatgcactccagtgtgggcgacagagtgagactccatctcaaaaaaaagactattctttcctccattgaattatcttcacatgcttgttggaagtctgttgactacaaatgtgaaagtttattactggactctgaattgtcctccactgaatctctatgtcttatccttatggcagtaccatactgtcttgattagagttactgtattttaaaaggctgtactttttcagttagcagaaaacattttagctatcagcacaactttctgtaaaccttcattaatgcttgacttaaattccaagaaggagcaacataaaaagtcttatctctttaggagttttagtcttactacttttaggtgcctgaataaccaaatgtattatttagcctcttactaataactccttgatccataggggcataccaggaagaaaagaagtggtttttaaaaaatgagagtgggccgggcacggtggctgatacctataatcctaacactttgggaggctgaggcgggtggatcacttgaggtcaggagtttgagaccagcctggataacatggcgaaaccctatctttattaaaaatatataaattagccgggcatggtggcacatgcctgtaatcccagctactcaggaggctgaggcaggagaatcacttgaatccaggaggtggaggttgcagtgatccgagattgcatcagtgggcgacagagcgagaatctgtctcaaagaaaaaaaaagagagtggaaaaaaaaaatatgtgtcccagaacttaaattttaattaaaaaaaaataaaagagtgaactttctaattgttctcttcagataatataatgttattctcttatgttttattgcgtatttcctgtgtaccagatgctgttcttcatgcttgtatgttaaatcttgtctaacatctctgtcaagcaagttctgtttgtatctgcactgtgtatattaggcagcttgggcaaagagaagttaagtaatctgcccaaactcacatggctagtaagtaagagggctgaccatctggtgtttaagcttctagcagtgctttgaatagtaactaatgcatagtgcatgctgcactgtcagtcagtgattcattagagctaacttcatgacatgctcatagccccaaactgcatttgttcacaaatatctgtagtccttcatttaggcagaaatagaaataccttgtgtgtttgttgttccttcccttttgagccatatgcagagtgctgatagctttatttgtgtaagaattgctagtaatttgatctgttttgggttaataatgtgggttttagaggtaaatggacctaggtttgaatgttggcctctatacatcatgtgcgtaacattgtggcatgctatctacttcccccaagccaaaatgggttaattttagaacctgcttcatagtgttcctgtgagagctcgatgagatattgcctataaagtgtttagcatagtgcctagcacatggtatgtattcaatacatgttcattcttactagcaaaatatagatgacccagtattgtacagagtatgtacaatggtgtcattgtaccatttcatgtggagtcacataagaatttcagttttctgctgggcatgatggctcactcctgtaatcccagcactttgggaggctgaggtggatggatcagctgaggtcaggagttccagaccagcctggccgacatgatgaaaccccatctctactaaaaatacaaaaaattagccaggcgtggtggcaggtgcctgtaatcccagctactcgcaagactgaggcaggagaaatgcttgaacccgggaggcggtggttgccatgagttaagatcgtgccgctgcactccagcctgggcaataagagcgaaactccgtctccaaaaaaaagaaaaaaaaagaacttaagttttccattagatttagtatagtgcagagaggaaatacagcagagtgctatattccatatatagcaatatagcattagaacaatatattccaatacagcagagtgctatattcagataccaactagtggacttgctatttgtaagatggcaataatagtatctacatcaaatagggctgttgtgaagactaaatgaataagtctataaatagtttagaacagtgtctggacaggtacagtggctcatgcctgaatcttagcactttgggaggctgagacaggtggatagcttgagctcaggcattaaagaccaacctgggtaacatggtaaaaccctgtttctacaaaaaaatacacacattagccaggtgtggtggcacatgctaatagtaccagctactcaggaggctgaggtgggagaatcacttgagcctgggagatggaggttgcagtgaggtgagcttgcaccactgcgctccagtctgggcaacggagtcagaccctgtttggaaaaaaaaaaaaaagtgtccaacccatagtaagaaatgcagatgtgtttgacattgtaagaaaaagcaacaccaaaagtctgatttttgccttcactcaagaactcttatgataattaaactccgaagtccttggcaatatatatagttggtctgttatgtggatcgcctctactaaagatttttgtgaacaaatgaaagtttaagtagtaagttcctacatcgtgacttaaattgccagtgtgcccacataaataccctgtcaacatttgcccttagccacttgactctttagctatattggtaatgcagtaaagcttgcgatgcgccagagttgcataatgctgtttgccatgacaccaagagccttggtaatgaaaccattgaaattggtttgcctatactgaggctgaagaggtatcttggctctctaattttaaggcaacctttttggctgtgtaggtttctctttagcttgtttctcaccacctggggctgtggcttaggtccgttgtcctaacctgtggcttaggttctgtttttgttgcttgtacttgctcccccttttttcagccattcctgttttctttcttttgtagaggatgccatcttaaatcatcttcagccagtggtagcattttattttttctggtctgcaaacttaaaaacctcatcacttattttgctaatatctttgtcttctgttctttttgatggtccttggttttgcagtctactttaaaggtttttatttttttatgggtacatagtagacgtattattcatagggtctgtgagatatttagataaaggcatataatgtgtaataatcacattagggtaaatggggtatccatcaccatcatcattcatcatttctttgtgtaatgaacgttgcaattgtactccctcagttattctaaaaagtacaacaaattaatgctgactgtagtcaccctgctttgttgtcaaatactagatcttattcattctttatttaactttttaaattttaaacttattttatttatttatttttagacggagtctcactctgtcgccaggctggagtgcggtggcgcagtctcaactcactgcaacctccgcctccagggttcaagtgattctcctgcctcagcctcctgactagctggaactacaggcacgtgccaccacgcccagctaatttttgtatttttagtagagacggggtttcactatgttggctgggatggtcttgatctcttgaccttgtgatccggctgccacagcctcccaaagtgctggggttgcaggcgtgagccaccgtgcccggcctttaaaattattttaaatcattttaatatctttttcatttctgcctccggtcctgcagagttcttattcgttctttctaaattttctttgcacccactaatcacctcatttcccttcttctccccattacccttcccaacttctggtaaccattctgctatctccatgtgttcaattgtttttatttttagtgcctgcaaacgagtaagaatatgcaaagtttatctttctgtccctggcttattttacttaacataatgtcctccagtgccatctacattgctgcaaatgacaggatctcattcttttttatggctgaatggtaatctattgtgtatatataccacattttctttctccatttgtctgtcagtggacacgtaggttgattccaaatcttggctgttgtgtatatagtgccgtagtaaacatgggagtgcagatattccttcaataaactgatttcctttctgagtatatacctagcagtgcaattgctggatcatatggtagctctatttttagttttttgaggaatttccatactgttctccatagtggttttaccaatttacatgtccaccaacagtgtgtgaaggttcccctttatccacatcgttaccagcatttgttattgcctgtcttttggataaaagccattttaactggggtgagatgatatcttgttgtagttttaatttccatttttctggtgatcagtagtattgaatacctttcatatacctgtttgccattcataaataacgatgaggtcttgctgtttggcccaggctggtctcgaactcctgggctcaagcaatcctcccaccttggcttcccaaaatgctgaaattatagttgtgagccactgcacctggccttgtatgtcttccttttttttttgttttgttttgtttttgagacagagtctcactttgttgcccaggctggagcgtagtggtgtgatcttggctcactgcgccctacacctcccggattcaagcaattctcctgcctcctgccaccatgtctgcctaatttttgtatttttagtagagacgggatttctccttgttgcccaggctggtcttgaactcctaacctcaggtgatttacctgcctcagcctcccaaagtgctaggattacaggcgtgagctgctgcgcccagcctgtatgtcgtcttttgagaaatgtctattcagatcttttgcccatttttaattgagttactaaaattttccctatggagttgcttgagtgccttttatattctggttattgatcccttgtcagatgagtagtttgcaaatattttctcccattctgtgggctgtctcttcactttgttgatggtttcctttgctgtgcagaagctttttaacttgatgtgatcccatttgtccatctttgctttggttgcctgtacttttggggtattactcaagaaatctttgcccagagtaatgtccctgggagtttaatgttttcttttagtagtttcatagtttgaggtcttagatttaaatctttagtccattttgatttgatttttttttaatatggtgggacacaggggtctggtttcattcttctgcatatggatatccagttttcccagcaccatttattgaagagactgtcctttccccagtgtatgttcatggcttctttgtggaaaatgagttcacttagacgtatggattcatttctgagttctctgttctgtttcattgatctatatctttttttatgccagtaccatgccattttggttacaataatttgaagtcagataatgattcctcccgttttgttcattttgctcagtatggcttttgctcttttgggccttttgtggttccctacaaattttagaattatttttgtctacttctgtgaggaatgtcattggtattttgatagggattgcactgaatctgtagattgctttgagtattatcaacattttagcaatattaattcttctaatccataaacatggaatctcttttcatgttttttctgtgtcatcaatttcagtgttttaaagttgtcattatagaaatcttttactcatttggttaagtttattcctaagtattttattatatttgtagctattgtaaatgggattgcgtttaaaaaatttttcagattgtttgctgttaaatataaaaatgctcctgatttttgtgtgttgatttttgtatcctgcaattttactgaatttgtttgtcagttctaataggtttttcttttttggagtctaggtttttccaaatgtaagatcatattatctgcaaacaaggataatttgacttcttccattccagtgtggatgctttttatttctttctgttgtctgattgctccaattaggacttccgagtattatgttgaataacaatggtgaaagtgggcatccttgtcttgttccagatcttagaggaaagcctttcagtttttcccttttcagtatggtactagttatgggtctgtcatatatggcttctgttttgttgaggtatattccttctatacccagttctttggggtttttttgtttgtttgtttttgagatggagtctcactctgtcacccaggctggagtgcagtggcgcaatgttggctcactgcaagctccacctcctgggttcatgccgttctcctgcctcagcctcccgagtagctgggactacaggtgtccgctaacacgcccggctaattttttgtatttttagtagagacggggtttcaccgtgttagccaggatggtctcgaactcctgacctcatgatctgcccgtctcagcctcccaaagtgctgggattacaggcgtgagccaccacgcccggccaagggttttaatcataaggggatgtggcattttatgtgatataaattatatatttatatcatgtgatatatatttatatcatacacagtataaataatatatatatatattttttagtctttgtcttttattctgttaagatgtaccatgtttattgatttgcgtatgtcgaaccatccttgcatccctgggatgaatcccacttagtcatgatgaatgatctttttaatgtgttactgaattcggtttgctagtattatattgaggatttttgcataatgttcttcagagacactggcttctagttttccctttttgatgtgtcctttggttttgtatagggtaatagtggccttgtagaatgagtttagaagtattccctcttcctgtattgtgttggaatagtttgagtaggattggtattagttcttctttaaaggtttagtagaattcagcagtgaagccatcaggtccatggcttttctttgctgggagactatttcttatagctttgatctcgttacttgttattggtctcgttacttgttattgtatttgggttttggatttctttgtggttcagtcttggtaggttgtatgtgtctaggaatttatccatttcttcaaggttttccaatgtatcagcatatagatgctcatagtagtctctaatgatcctttgaatttcggtggtaacaattataatgtctcctttttcatctctcattttattatttgggttttctcttttttttctgagtctggctaaaggtttgtcagttttgtttatctcttcaaaacaatttactgttttattgatcttttgtattttcttcatttcaattttatttatttctgctttgattttttttatttcttctactgattttaggttttgtccttgcttttctagttctttaggatgtattggcagatgaagtttttccacttttttgatgtaggcacttactgctgtaaacattcctcttattgttgcttttactgtatcctataggttttgataagctgtgtttccattttcatttgtttcaaggaattttccagttttcttcttaatttcttcatggacccactggtcattcaggagcatattgcttaattttcatgtatttgtatactttccaaagttcctcttgttatctagtgttattttattttatttttatttttgtttttttgagatggagtctcgctctgtcacccatgctggagtgtagtggcgcgatctcggcttactgcaacctctgcctccccagttcaagtgattcttctgcctcagcctcctgagtagctgggattacaggcatgtaccaccactcctggctaatttttttttgtatttttagtagagagggggtttcaccatgttggtcaagctgatctcgaactcctgacctcagatgatccacccaccttggcctcctaaagtgctggaattacaggcatgagccaccgtgcccggcctctagtgttatcttattgtgatcagagaagatagttgatatgattttaacttttttgaatttttatttatttatttgtttgtttgtttgtttgtttgtaacagagtctcactctgttacccaggctggagtacatgtcatgatcttggctcacctgcaacctccgccttcctggctcaagcaatcctcccaccttagccttccaagtagctgggactacaggcacatgccgtcacatatggctgatatttttggattttttttttttttgtagagatggggctttgcgatgtgtcccagggttgtttcgaactcctgagctcaagcaatccacctatttcggcctcccaaggtgctgggattacagacatgagccactgtgccacgtcaaatctttagacttgttttgtggcttaacatagggtctatctttgagagcaatccatatgttgaggagaagaatgtgtattctatagctgttggacacaatgttctgtaaatatgtattgggcctatttggtctatagagcaaattaggtctaatgtttctttgttgattttctgtctgaatgatctgtccattgctgagagtggggtgttgaagtttccgactgttactgaggtctgtttctcttttttgctctaataatgtttgctttatatatctggatgctccagtattggttgcatatgtatttatacttgttataacctcttgccgaattgatccctttatcattatacaataatcttctttgtctgtttttatagactttgtctcaaaatctattttatctaagcatagctactcctgttcttttctggtttccatttgcatggaatattgttttccagctcttcaattttagtctatgtgtgattttataggtaaagtgtgtttcttgtaggcaatggatctttggtttttttttttttttttttgagacagagttttgctattgttgcccaggctggagggcaatggcgctatctcagctcactgcaacctccgcctcctgagttcaagcgattctcctgcctcagcctcccaagtagctgggattacaggcgcctgccaccaagcccagctaaattttttgtattttcagtagagatggggtttcagtatgttcgtcaggctgttcttgaactcctaacctcaggtgatttgcctgccttggcctcccaaagtcctgggattacaggcgtgagccaccgcacccagccttttttttaaatccatttagccactctgtatcttttgattggagagtttagtcgatttacattcagtgttgttactgattagtgaggacttaactactaccattttgttacttattatctggttgttttgtagtcctactccctcccttcccccttcttttttacttcctcttcgctccttttttccctccctcccttccttgttttgaaagtgattttctctggtggtatgttttaatttcctgctttatattttttgtgtatctgttgtaggtgtttttgatttaagatcaccatgacagctgggtgcagtggttcacacctgtaatcccagcactttgggaggccgaggtgggtggatcaagaggtcaggagattgagaccagcctggctaacatggtgaaaccccatctctactaaaaatacaaaacttagccaggcgtggaggcacgtgcctgtaatctcagatactcaggaggctgaggcaggagaattgcttgaacccaggaggcagaggttgcagtgagtcaatattgtgccactgcaccccagcctgggcgacagagtgagactccgtctcaaaaaaaaaaaaaaaaaagagatcacataagggttgcaaataacattttataacccattattttaaaccaatgacaacttgaaactttgattgcaaaaacaagcaagcaaagagaaaactaataaaaactctacacttcatctgcccgctttttaacttttgttgtttttatttatatctttattatactatgtcttaaaaaactgtagttataagccaggcgcagtggttcacgtgtgtaatcccagcactttgggaggctgaggtgggcggatcacctaaggtcaggagttcgagaccagcctagccaatatggcaaaaccccctctctactaaaaatagaaaaattagccggacatggtggcgggtgcctgtaatcccagctactcggaggctgaggcaggagaatcacttgaacccaggaggcccaggttgcagtgagccgagagtgcgccactgcactccagtctgggcaacagagtaagactgtctcaaaaaacaatacaaaacaaaacaaaaccctggcctagtggctcacgcctaatcccagcactttggaaggcaaaggtggggcgaatcacaaggttaggagttcgagaccagcctgaccaacgtggtgaaactctgtctctactaaaaatacaaaaattagccaggcgtggtggcacgcacctgtaatcctagctactcaggaggctgaggcaggagaatcgcttgaacctgggaggcggaggttgcagttagccgagatcgcgccactgccgtccagcctgggcagcagagcaagactctgtctcacaaaaaaaaaaaaaattgtagttcttatttttgaaaggttcattttttattcttcctgctcaaaatatgagtagtagtttatacaccacaattacagtgttacaatattctgtatttttctgtgtacttgttaccagtgagtttttgcaccttcaggtgatttattattgtttgttaacatccttttcttgcagattgaagaactttttttttttttttttttttttgagacagagtcatgctctgttaccagcctggagtgcagtggtgccatcttggctcactacaacctccaactcccaggttcaagcgattcttctgcctcagcctcccaagtagctgggattacaagcatgtgccaccacgcccagctactttttgtatttttagtaaagacggggttttgccatatttgccaggctggtcttgagctcctgacctcagggtgatccgcccgccttggcatcctaaagtgctaggattataagcgtgagtcatcgtgcccaacttggttgtttattttcaaatagcctgaattcaagctcactaatgttttctgctgcttgatacatttctgctattgagagactgatgcatttttcagtttgtcaattgaatttttccactttgggatttctgcttgattctttttactaataattattgcagtctcttttttaaatttataggattctgaatttgttctctgtattatcttggatttcgttgaactttctcaaagcattcagcttgaattctgtctgaaagttcacatatctcttatcacttgggaattggtcactggtgtcctttatttttagttcatttggtgaggtcatgttttctcagatggccttgatgcttgtggatgttcatcagtgtctgggcattgaagagttgggtattctgttctttgtagtctggttttgtttgtacgcattcttttttttttttttctgtttttgagacagagtctcgctctgtcgcccaggctggagtgcagtggcacagtctttgctcaccgcaacctccgtctcccggattcaagcaattctcctgcctcagcctcctgagtagctgggattacaggtgcgtgccaccacgcctggctaatttttgtatttttagtaaatatggtgtttcaccatgttggtcaggctggtctcgaactcctaacctcgtgatctgtccgccttggcctctcagagtgttgggattacaggcgttagccactgcatccggctcccattcttcttgagaaggtttttcaagtattcaaagggaattaagtgttgtcatctaagtcttcgctcactgcagccatacatgcattagagggcaccccaagactagtaatgttgtgactctgtagaggtatcaccttggtagtcttggggaagatctgggagaattccctgtattaccaggcagtctcttgtcctcttacatttctccaaacaaatggagtctctctttgtgctgagctgcttggagtttggggaagggtgacacaagcactgccatggccaccgtcactggaactgtacttggtctcacccaaggcctgtggcagctattttctggccaccactgatgttaatttaaggcccaagggtgctttagtcagtaggtgaagaatcctgcaagaactgggtctttactttcagtgcagcaggttcccttctggcccagggtgtgtctagaaatgctgcccaggagccagggcctgggatcgggagctttaggaatctgctttattgtactggggctgagctggcacccacttgcaagataaagtcctttttactcttctctcacctcaagcaggtgggtctccccatggacaccacagctgtgaatgtgcggggtcatatctgaagctggcacaatacgacatggcaccttgttttttattcaaggcacaagggctctttagtcagctggtggtgaatcctactaggactaggtatttcccttcaaggcaatgggttcccttctggtccagaatatgtctagaaatgtcatctgggagctatggcctagaattgaggcttcagaactatgcttggtgctttattttactgtggctgaactagtatccacattgcaagacaaagtcctccctactcttccctctcctcccagagctgtgagctgtggtacctggagttgggggaaggctggcacaagcactcccttggccaccctagctggtgtctcagtgggtcacatgtaccccaagtccactgactatgagcccagcacagtaccatgacttgtccaggaattgcagtccttctggtctagactgcctttcaagtttatttaggaccccagaggactttacccacggtggtggggcttaccaaaattaagattcttttggttttttttggcagagtttcgctcttattgcccaggctggagtatagtgacgcaatctcagctcaccacaacctccgcctcccgggttcaaataattctcctacctcagcctcctgagtagctgggattaccggcatgcgctaccacctctggctaatttttttgttttttagtagagatgaggtttctccatgttggtcaggctggtcttgaactcccgacctcaggttatccgtccgcctcggcctcccaaagtgctgggattacagaccatagtgcccagcccgaaattcagattctaatcactgggatggacaattcccctctgactagggctagtctaaatactccctctgtgggtgctggctgaattctgtcctatgctgctttccactgtgacagggcagcactgagtttcaatgcaaaatcccacagtcatttctctctctctcccccgagcacacagattctttctccaccccacactgcattgtgggggaatgtcaggggtgttggaggggcagttcaagactatcttccttatcttttttggtgtctttttccttgataggatgtcaaaactgggtactgtgatcgcttacctaatttttggttcttatgaaggtgctttcttgtgtggatagttgttcaatttggtgctccttgttggggatgatcactggaaggttctgtttggccaccatgctctgtctcttctcccctgccatctcctttttttacttaggggtttagaatgtctaactgaccaatatgtacagtcaggtctcattctgaattcacctacttaatgaccttccaagctgactaggcccagcgcttagtccagcctccatgacggtccctccacatcctaattagcctccctccagttcatttcacacaaagctgctgtgttcacctttctgaactataaatctgcccagtactctaccctacttaaaattccgtatagactgcccatttgccctgagaattaaaagccaaagtcctaaacgtagctttttaaaacttttttttttttttttttaatttttagatggagtcttgctctgtcacccaggctggagtgcagtggtgtgatcttggctcactgcaacctccgcctcctgggttcaagcaattctcatatgtcagcctcccaagtagctgggatttacacgtgtgccatcacgcctggctaattttttttttttatctttagtagagacggagtttcaccatgttggccagtctggtcttaaactcctgacctcaagtgatccacctgccttggcttcccaaagtgctaggatgataggtgttagccactgcacgcagccctgaacatagcttttaagttcctttattgtcatattccttttgacgagtctatcattttctgactcacttgtacatgtgtgtctcacccttggtccagccattggtgcttttctttacttctttatttttgttattttattttattttattattattttttaaatgagacagggtatcactatgttgcccaggctggtcttgaactcctgagcttaagcagtctgcttgtctcagcctcccaaagggctggaattacagtgatgagctactgtgcccagctcattggtgctatctttttttttttttttgagacggagtctcgctctgtcacccaggctggagtgcagtggcgtgatcttggctcactgcagctccacttcccaggttcacaccattctcctacctcagcctcccgagtagcagggactataggcgcctgccaccatgcctggctaatttttgtatttttagtagagatggggtttcagcgtgtgagccaagatggtctcgatctcctgacctcgtgatccgcctgccttggcctcccaaagtgctgggattacaggcgtgagccaccgtgcccggcccccattggtgctattgttttatgtgatagagccagcttctcccttttctttggatttttaaacatactcttccttttacttagactattctccatcccaacacctttcctaaacttctttcacaccttagactagctgacactttactgagaaacctttcttttttataggttgctttttctatagactctcttagcatttactcattttattgtgaagtgtctgatcttatttaaatgacaagtataagaggatagaaactatttcatatttttctcacccagcaggcacaatttctgacatgtggtaagcactcagtaaatattgaactttagaggctaggacatttgagtgctttggtgactgtggttgtgctatataggtactctgttattgttagtttatagtaaaagcattactcttaaagtatgaaaaaagccttattcagaacatttcatgcgtatagttaatattacgtagcttgtgctcatggcaaaaatgtattactaaagttatttaagatatttaagtataattgtttcctttatttagttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagtgagtaaacctggaacttagaccatcctgttactcaattaacttttttttttttaaaggcatttaggtccttccaactgtgaagaatccatctggacttttagactactttatacattgcccttagtttacaaacagctagtccaaacaaatgacatcttaagtaaatgaggttattgcaccctgtgctactcttctgttcttccccttttttgtaccccagggctagaaaaacaaggcataaattaagaaaagtttttctgtaaatgaacaggagttgaaaaattatcaattcaggggacctatctttactggattccactcattagtcaccctcactgtgctgctaggttgaaaaactgccactgtcaaggagagaagcatgcggtgcttctacttggaattcaaaatatttttcatcagaaactgtgttttagttaatgtttagatttgttaagatagacttaattctgcacattcagtatattaattaaatggacttttaggggctaacctcagaacttaactaccattgacttaggtgtttgggtaccaaacaatccagttaaagctgaagttttggaatgcagcttattgataaattggggactgcttattcttgatttgaggcaatttttttttacagccatgactttttccaggtatgtcatgtaaaatatcttctcacataagaattactgcatgctagaatattggtatgttgactggtagctcatacctataatcccagcactctgggaggtccaagcaggtagattacttgaggttaggagttgaagaccagcctggccaacatgtgaaaccctgtctgtactaaaaatacaaaaattagccaggcatggtggtaggtgcctgtatcccagctactcgggaggctgaggcaggagaattgcttgaacccagaaggtggaggctgcagtgagccgagatcatgccactgcactccagcctgggtgacagagcgagactctgtctcaaaaataaataaataaataaataaaaggatactgttatgttaagaattgcttttaaggatatttcataagtagctactgtcttttcagctcaagtgtttgttgattggccaggcgtggtagctcatacctgtaatcccagcactttgggaggctgagtcaggcagatcacttaaggtcagcgtggccaaaatggtgaaaccccatctttactaaaaataaatattaaaaaaaattagctgggcgtggtggcagtctcctgtaatcccagctaatcaggaggctaaggcaagagaatggcttaaactcgggaggcagaggttgcagtgagccaagattgcactgctgcactccaacctgagcaacagagtgggactctgtgaaggaaaaaaaaaaagtattttttgattgcctttgagaggaacggttgtatattactcagatttttaaaaaattgttcttttatggctgtattctttaagggattaaggaatgggcaatataagtgtatatgtttcaataaaaacgattagtgatcttctagtgagaacagtttaaatctatatttagcaattttttttaaattgtcaggtatggaagattttagagcaacgtaaagtccatgtagatttcactggcctttatattttttttaggcaagttaggaaatcaacattgaatcccaatgcaaaggagttcaacccacgttccttctctcaggtaggtttattactttctttgaggttatctagtcccaaaaaaagaaaaattattagtaatagtccttcttccatacctgccatctgaattttgttttagtgtgctgaaccaaccttctttcttttttttacatggccattaatgaatactttttaaacattaaaaaaaggtctttgttttgtcatcaattagatgtgatcttgggcaaatctttgaatttctctgacccagaatttgacgatggttggctagctaggctgtcaggtttatagatacgtcctctgcacctgagggttttgcatcactggattcaaccaaccatggatcaaaaacatagttaggataatctatactgaacacatgcagacgtttccttgtcattattccaaaacaatacagtaaagcatttaccttgttttaggtattataaataatctagagatgatgtaaagtatataggaggatatgcataggttgtatgcgaatactacatgattttatgtaagggacttgagcattccaagactttggtatcttcacagggtactgtaaccaatcccccacagatactaagagatgactgtactattgttattattcgactgagatcataagaagatatatttatttttaatttttaaaaacacttccatcagtttcttaaaaatagctgccactgtttttaatattttttaattgacaaagttttaagttcctactgaaacattttttcttttattgaaatgtgaaaatttatgtgctgtgtttttgttttcaataaaagggacatagttaaagcaagtaaaattagaaagactgggaaaatccgtctttaaattgcaataatagttcatctgttaccttgagataattgaatttattgttgtttttgtagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaagtaagtcatagaatttgatgttcacttagcctccccaattgtttgtatctgacaccaagcactctttaggttttcagtgacttgagggtgtgatggttatgcatatgcatttgaaacagacaggcatgcagagattcagtgtgttgttaagtatgaggacctaaatctgagaatgttttctgtgaaaaagatggtttagatttactgtagtttggggtttgttccttttagctgtgggtatgatctaattttttaatgactaatggagaatcaggaaaccttctcatgcctagctctctagcaatataaaactaagagtgacagaataccttgttattatcataggtgcctaatgttaattttttttttaattctctcaagcctttatacccaatacctatgacgcccatgccagtgaatcaagccaagacatatagagcaggtaaaggtgagaataatcctgcctgtgtttgcttgtagtttgcatgctgcatgaattgagtaactaagtttataatgaataaatagttgtagtttagctctgactttttgatgaggctatgcattggcttttgatgaacaacattacatagatattcacatggattttatgaagaaaaacaggggagaaaaaatgcccatcagttgtgattatatagtatcctcttcaaaaagagtaattggaggcctggtgtgatggctcacacctgtaattttagcactttgggaggccaaggcaggaggattgcttgagctcaggagcccaagatcagcctggacaacagagactttgtctctactaaaattcaaaaaaattagctgggcatggtggcatatgcctgtagccccagctgtttgggggactgaggcgagaggatcacttgagcccaggaagtagaggctgcagtgagctgtgattatgccactgccctccagcctgggcgacagagtgagaccccgtctcaaacataaatactggctgggcatggtggcttatgcctgtaatcccagcactttgggaggccgaggtgggtgtatcacctgaggtcagtagtttgagaccagcctggccaacatggcgaaaccccatctctactaaaatacaaaaattagccggacatggtggcacctgccgcctgtaatcccagctactaggtggggctgaggcaggagaattgcttgaacccgggaggcaggggttgcagtgagccaagatcgtgccactgcacttcagcctgggcaacagagtgagactccatctcaaaacaaacaaacaaacaaaaaacaaacaaacaaaaaaaccagactaattggctggacacagtggctccatgcctgatatcccagctggaggatgacttgaacccatgagttcgagagcagcatgggcaatatagtgagaccctatctcaaaaaaaaaaaaaaaagttaattccaaagctttttgatctgaaatctgatttaaatctgaacttaaatttgaagaagagggtttgctagattaatttactagattgctaaccttgctttatatatacctacagttatttccccaaagccagaatttcttttgaagcagaggggcaactaacttcaaccaatgttaagatcctattagaaggatgtttcggctaggcttggtggctcacgtgtaattccagcactttgagaggctgaggtgggcagatcacatgaccgggagttttaagaccagcctgggcaacatggcaaaaacctatctctgcaaaaaaaaaatagaaatcttagccagccgtcatggtgtgctcctgtagtcctagctacttgggagactgaggtgggaggatcaattgaaaccagaaggtccaggctgcagggaactgtgactgcaccactgggctccagcttgggtgaaagagcgaaaccctgcctcaaaaagaaaaataagatggatgtttctgcattaaaattagggagttgtcgtataatgtagttgcataaactagtattctgtgcttgtgtggttaaagagccttcgtagaaaaaatcccacatttttcttaaaaggaaatcttttggccaggtgtggtggctcacatctgtaagcccaacactctgggaagccgaggtgggcagatcacttgaggtcaggagtacaaaaccatcctggccaacatggtgaaaacccgtctctactaaaaatacaaagatcagctgggcatggtggtgcgtgcctgggtgacagagcgagactccgtccaaaaaaaaaaaaaaaaaaaaagagttcttttaatgttggaaaatgctaaagggttttttttttgccaaccagttaatttagagtgattaactgctatcagttgagaaactatagaaagtagaataatttatacagaaaagacatttctcagtgcccaataattgcctttctgacataaagttttcatttttcctgaattaataagatttcctcaatgtgtttttttgggtgttttgtgtgtgtgtgtgtgtgtgtgtgtgtgtgtgtgtgtgtgtgtgtatgtgtttgatacagggtcttgctttgctgctgaggctggaacgcagtggcgctatcatggctcaatgcagccttgacctcctgggctcaagcgatcctcccttctcagtcccctggatagcgggggctacaggtgcacaccaccacacctagctaatttttgtattttttgtagagatgggttttgccatgttgcctaggctggtctcaaactcctgggctcaagcgatctgcctggctctgcttcccaaagtgcctgcgcccagccaattttctccatgtttgacctaattgtgatttcatagatgttaactaaaactcttaattttcgttttctcagtatgctattttttttttttttagccttggaacatatgaacctgttgaaagaactctgcctgaaataatgtaatcaaattatagagtttaatcttattttgagggcctttagaaattctgagaagaaagtgggtttttttttttactgccattttaatgtagtgttaaggtgttcatgtatcaccagcaggtgtagctgttttcaatgattacttaaaacaatgcaatgggaactttttgttgtcattaaaatataaaaggttactgtagtaagagcaagcatgacagtttggctatctgatgggagagtcacattctaacttcaggaggtactgtctttttaatagaaatgatatactcagagtctgggcacggtggctcacgcctgtaatccagcactttgggaggccgaggtgggcagatcacgaggtcaggagatcaagaccatcctggctaatacagtgaaaccgtgtctctactaaaaatacaaacaattagctgagcgtggtggcaggtgcctatagtcccagctactcgggaggctgaggcaggagaatggcatgaacctgggaggcagagctggcagtgagctgagatggtgccactgcactccagcctgggtgacagagcgagactccgtctcaaaaaaaaaaaaaaaaaaaaaatagtagagaaagggctttgccatgttggccgggctggtcttgaactcctggcctcaagtgatccacctccctcggcctcccaaagtgctgggattacaggtgtgagccactgctcctggcctgaatataccacttttacctatcatcagttgatgaacatttggattatttcctttttctggcaatgagtaatgcttttgtggattttcatgtacaaattttcatatgaggctgggagcagtggctcatgcctataatcccagcagtctgggaggctgaggtgggcagatgacttgaggtcaggagtttgagaccagcctggccaacatggtgaaatcccatctctactaaaaatacaaaaattacactggcatggtagcgtgcacctataatcccagctattcaggaggctgaggcaggagcatcagaatcgcttgaacctgggaggcggaggctgcagtgagctgagatcacaccactgcaccccagcctgagtgaaagagtgagtctcaaaaaataaaaaataaaattttttttcatgtggccttagattttcatttctcctaaagtagaaatgctgtgatggaactgccaaacttttccaaagcagctgcatcattttgtatttctaccagtaatgtacaagtgttccagtttctccacatcctcataaataaccgatatgtctttggtttgggttatgtccattctagtggttatgaagtgtcattgtggttttttgtttttttgtattgttttgagatcgtgcccaggctggagcacagtggcacaatctcggctcactgcagccttcgcttcctgggttcaagcaattctcctgcctcaccctcccagatagctggggctgcaggcatacgccaccacaccaggctaatttttatattttttgtagagatggagcttctccgtgcttcccaggctggtctcgaattcctgagctcaagcgatccccctgcgtcagcctccagagtagctggggttataggcgtgcaccaccgcgctcggcccatttttgtatttttagtagagatggaatttcaccatgttggccaggctggtcttgaactcctgacctcaaatgatccgcctgcctcaccttcccaaagtgctgagattttagacgcgaaccaccatgccctgactataggttatctttttacttgcttgatggtgttctttgtaacacagtttttaattttgatgaagttcaatttatctgtttgttttttcttttgttgctgttgctcctgatgtcatatcagacaaagcattgcctaactcaaggccacagagatttactcctatgaaacgcctataaaactcctatgatttttatagtttagctcttaacatttaagtctacaatctcttttgagttaatttttgtgtatgagatgagagtagtggtccaggtttttccttttgcttgtggatatccgttgtccccacctcatttgttgaaaagactattctttcctcttaaattgtttgtttgtttatttatttttgagatggagtgtcgctctgatggagtggcgctaacttagcttcactgcaacctccgcctctcagattcaagcgattcccctgcctcagcctcctgagtagctggaattacaggggtgcgccaccacacccagctaatttttgtatttttagtagagacggggttttaccgtgttggtcaggctggtctcgaactcctgatctcgtgatctgcctgtctcctggcaccctgggaggctgagaggctgaggtgggaggatcacttgagctcaggagtttgagaccagcctgtaccattatgcctggctaattttagaatttatcttaaagtataaaatgtgaatccaatttatcttgttctaaatgactatccaaaatgttttaaccagttttattagtctgtaatttacatacaagaaaatgctcatctttttatgtttacattttaatgagttttgacaaatatatttgctcatgtaactacttgcttcatcagtgaagatggaaaacattgtgcctgttcctcttctctgtccaactgtactttattaccactagctccagttaaccagtaatctgccttcttttactatagattagatttatcctctttagatttctttttctttttttttttttgattaggtttttttttttctttttttacgtaaaaaaatctttttttggagacgtctcattatattgcccaggttggtctcgaactcttgagctcacctcagcctcccagagtgctaggattacagatgtgagccacctcagccagcccctagattttttttttttttttaataaatggaatcaaacagcgtgtaacagaggtgttcaatcttttggcttccctgggtcatattggaagaagaattgtgttgggccacacataaaatacagtaacactaatgatagctgatgaacaaaacaaaaaaaaatagcaaaacttataatgttttaagaaagtttatgaatttgtgttgggccacattcaaagccgtcccaggacgcaagttggacaagcttggtatataatttcatatgtgtgtcctaaacagtgtagtaatttgaatttcatgttagtatcagcttattcctttttgtttgtttgtttgtttttgagatggagtcttgttctgtgtcccagaattggtctgcaattccactgcctcagcctcccaagtagctgggattacaggcacgtgccaccacacctggctaatttttgtctctctctcttttttttttttttttttttttttttagcagagacgggatttcaccatgttggccaggctggtctcaaactcctgaccccaaatgatccacctgccttggcctcccaaagtgctgggattacaggtgtgagtcaccgtgcccagccagcttattcctttttattgctgggtagcatttcattttatgattataccacagttaatttacccattactagtcgatgggcatttgagttattgccagcttttggctattatgaatgaagctgctgtgagcatttgtgtacaagtgtttgtgtttttatttcttttagttaaatacctagaattggaattgctgaggtatggtaagtgcatatttcatttttttaaaaaatttattttattttttatttatttattttttttgagatgaagtctcactctgttgcccaggctggagttcagtggcgtgatttcagctcatggcaacctccctgtcccgggttcaagcaattctcccgcctcagcctcccaagtagctgggattacaggcgcgcaccaccatgcctggctaatttttttgtatttttagtagagacggggtttcaccacgttggccaggctggtctcgaactcctgaccacaagtgatccacccgccccagcctcccaaagtgttgggattacagatgtgagccaccacacactgcctggtaaatacatatttcaattaataagaaactagcaatcttctaaagtgattgtgtcattttacattccaactgatcaggtacatgtgtaggttccatgtgttctgcatccttgccaacacttggtattgtgttatctttttaatttcaacaggtctaatgggtgtcttatggtatctcattgtgatcttaaatgtacatttctctgatgatgactgatccaggagcacctcatcatgtgtgtgtttgttttcagctgtcaacctttttttagtaaatggttcaaatcttttttccattttatttatttatttatttatttgatggaatctcactctattgcccaggctggaacgcagtggtgccatcttggctcactgcaacctccgcctcccaggttcaagcaattcttacgccttagcctcccaagtagctgggattacaggcatgcgccaccatgcctggctaattttgtatttttagtgtaggtggggtttcaccatgttggtcatgctggtctctaactcctgacctcaggtgatctacctgcctcggcctcccaaagtgctgagattacaggtgtgagccactgcgcctgtcctaataatttctttttgtctcaatgtttctgcctgggtgcactggctcacgcctgtaattccagcactttgggaggccaacctggatggatcatttgagccaacagtttgagaccagcctgaggaacatgacaaaaccctgtctttgcaaaaaaaaaaaagaaaaaagaaaaattagccaggcacagaagcgcattcctatggtcccagctacttggggggctgaggtgggacaatcgcttgagcgaggttgcgggggtttggagggcgatggaggggtgatcgaggttgcagtgagctgagattgcactactgcactccagcctgggcaatagagccagaccctgtctcacaaaaaaaagaaaaaaaagtcatgtttcttttcttactgtgaaaataaagttactacttttagtaaattattttaagttatttatatattctggttacaagtcctttctcagaatattgtgaatattttctcccagtctgcggttttttttgaagagccagtattgttaattttaatgaagccttatttatcaagcttttctcttaaggttcatgcttttttgtatcataataagaaatcttttacgtaccctaggttatgaatgtttttatggttaggtatatggttgatttcaggttaggttttgtgtagggtgtgatgtaaaggtctagcttcattttctccaccataaatatttactcggtttctctggcaccagcctctgttttccattggtggctttattttttttctgttcttgaaacaagagtctcgatcttgttacccaggctggagtgcagtagtgtgaccttggctcactgcaacctccacttcccagggtcaagcgattctgcctcagcctctcgagtagctaggattacaggtgcccgccactacacccagctaatttgtattttttttttttttttttttagtagagacagggtctcaccatgttggccaggctagtctcgaactcctgacctcaggtgatctgctcatctcagcctcccaaagttctgggattacaggcatgagccactgcgcccagccatagtagctttattgaattcagttgactgtattgtatgtgtgtctatttgtgaactgttttgttgtattgatctttgtatatatccttatgccaattctctctttattgctgttactttgtaaccaacctttaagttcatatgagtctcccagttttattctcgtcaaaattactcttattctgcgttctttgaatttgcaaataaattttagaatcagcttgggattgtgcactgaatctttatatcagttctgggagaaatatcttaacaatatggaatcttcattgaggtcatcatatactgctccatttatttaagtcttaagtttcaccagtgttttctagttttctttgtatcagttttgtgcctgctttcttaaatttatcccttaatatttcatctgttttgtgctgttgtgagttatattttaaaaactttcaacgtttgtttattcgtaaatagagatgcacttgatttttgaatattgaccttgtgtcttgatgtgttggtaaacccactgtttctggcagccctttaagacttaaacatacaatcatgatctaatcaccatgttggtgtttttgggttttttttttttgtcttattgtactggtgcattactgaaaaaggcatgagattttgccatgctcccatttttaggggtgagacattgtctttcactattaagcatacagttaggtgttacttcagttcctaatttgcagaggtgggtttgttttctttttaatcatgaatggttgttggattatgttcaaatacttatcatctactaagtatatcatattgaccaggaacagtggctcatacctgtaacctcagagctttgggaggccaaggcaggaggatcgcttgaggccaggagttcaagaccaacctgggtgatgtaggaaaaccccatatctacaaaacaatttaaaaatttgctgggtgtggtggcacacacctgtagtcctaactacttgagaggctgaggaaggagaattgcttgagcccagtagtttaaagcagcagtgagctgtgattgtaccactgtactccagcctgggtgacagaaggagaccctgtatttaaagtgtgtgtgtatgcgtgcgcatagatggatagataataatgtaattccattatggtcatacaaactgatatgaaatgccattttatcatataacaagtgtctttttgtggttgaatttgtttctggatttttcactctgcttcactaatctaataggactaccttctcatccactcactgccaacattgattttttttttcagattaccttgaattttctgtttatttttccatatgaactctataattaacttactactaaaaaaatcagttgcctttttaaaaccaactgatctttaaaatatatcttggctgggcccggtggcaggcacctgtaattctagctacttgggagactgaggcagaagaattgcttgaacccaggaggcggaagttgtagttgagttgagattgcgcacctgtactccagcctgggtgacagagcaagattccctcttaaaaaaaaaaaaaaaaaaaagaaacagaaaagataaatctttttacaataatttgttccaattagggtccaagtcaggcttgcaatttggatttgtttatatgttgaagtctttttttttttttaattgtttcatattgtggtaactttttttttttttttttgagatggaatcttggctctgtcacctaggctggagtacagtggcacaatctcaactcactgcaacctccccctctggggttcaagcaattctcctgcctcagcctcccaagtagcccagccttttttttttgagacagagtctcgctctgttgcccaggctggagtgcagtgatgcgatctcggctcactgcaagctccgcctcttgggttcatgccattctcctgcctcagcctcctgagtagctgggactacattcgcccgccaccacacccggctaatttttttgtatttttagtagagacagggtttcaccgtgttagccaggatggtatcgatctcctgacctcgtgatccgcccgcctcggcctcccaaagtgctgggattacaggtgtgagccactgcgcccggccttgtatttttaatagagatggggtttcaccatgttggccagcccggtcttgaactcctgacctcaaatgatccacccgcctcggcctcccaaagtgctgggattacaggtgtgagccatcgctctcagccttgcggtaactttttattacgaatgtattgagacattaataacctaggccagtcatgtttcatccctacccattgtctcttaaaagctttgagtccactggattattctgaagcaaattctagacattgcatcagtttatccaccaacattttagtgtgtatctttaagttggttttggttttgttttttgtttttgagatggggtctggctttgttgcccaggcttggagtgcagtagtgcaatcatagctcactgctgctgcgaattcctggtctcaaaggatcctccctcctcagcctctcaagtaactgtgactacaggcacatgccaccttgccagcttttcttttcttgtcttgtctttcttcttctttgtttttttgtttgttttttgtttttttttgagacagagtctcaccatctttctatcttgcccaggctagtcctaaattccagggcttaagttatctttctacctcagcctcctaaagtgctaggattacaggccagcactttaggaggtgctggatgagccatcacacccagccaagtcataggtttttttgtttgtttgttttttgagacagtgtctaactctgtcacccaagctggagtgcagtggcatgatttcagctcagtgcagtctctaccaattgggcttaggtggtcctcccacctcaacctcccaagtagctgggactaaaggtgcgcgccaccatacctggctaatttttgtattttttgtagagacagggtttcgaattcctgagctcaagcagtctgcctgccttgactcccaaggtgccaggattacaggcatgagccactgcactcagccctcacagttttaattacagtttttcccttagtttttgtcttgttcatatccagcttgtcttgtatttttttcccacgatctgaattttgctgactgtatccctgtgttgatatttaaagtagacttctgtcccctgtaatctttgtaaactgatagtaaataatgaaggcttgatcagattgggttttttttttttttccccaatgtttcacagatgtgtgtactttcagtgaggagtcatgtaatcagtctttttcctgataggagtagtcagtgagttcctagatgttttatctatccaggagataatatgtccctttagcgccttaatttttttggtgtgttttttagcagccattgatgataattgtctagcccaagatcagttatttccttaggggttgtaaaatggtgacattcttttcctttcatcccttcttcaattattgcctggaatatttctataaagaaaaactttcccatatccagctgtttggttaccctgaggtatagctttcttaggaaaagtaatttaaaatgttaatcatttccctttttaaggcagtcttcaaaataatgagttggttttctgttatcctccaaaggtaaccagtgaggtggtttttttgtcgttggttcttactatcagtataaacttctggaattttttttttttttttaattttttggagacaaggtctggctctgttacctaggctggagtgcagtgggatgatctgggcatactgcagcctcaacttcccgagctaaggcaatccccccacctcagcctcccaagtagctgggactacaggcaagcaccaccgtgcctggcttaatttttgtatattttgcagagacagggtttcaccatgttgcccaggctggtgtcgaactcctgagctcaagcagtctgcctgtgtcagcctcacaaagtggtgggactacaggcatgagccaccatggcaggccagaatcacaataaacttataaattaacttgagaagaaatgattgatgtcttcatgatgttgagtcttcctgttcaagaacaaagtataccttcaatagcatattaaagtttatccttggctggatgcagtggctgacgcctgtaatcccacctctttgggaggcagaggtgggcagatcacctgaggtctggagttcgagaccagcctggccaacatggtgaaaccccgtctctactaaaaatattttaaaaaaagtattagctgggtgtggtgtgcacctgtagtcccagctactctggaggctgaggtaggagaatcgcttgaacccaggaggcagagagtgcagtgagtcaagattgcaccactgcactccagcttgggcaaccgagcgacactctgtctcaaagaaaataaataaataaaaataaagtttatctttaaggttttgtacatttttttcagtgtatgccttaggtaggttcttttttaatgttagtgtaacccagggacttctcttccattgcatcttctaagtaattacttatgaagtaccatatatgaaggctattgctgtttatatgttagtttttaccctgctcctttactaaattccaatcctttgaggtattggataaaaatatttttagcatttttcaaataacaggcagagtcaagggcttggtttcttttcttcccctcctgtcccctaccctccccttttttgagacagggtctcacttcttcgccgaggctggagtgcagtggtgcagttacggcttaccgcggcatctgcctccctggctgaaaagttcctcccacctcagcctcctgagtagctgggaccatagatgcacagcaccgcagctggctaatatttttgtattttttgtggaggcagtgtctccccatgttgcccagggtggtcccaaactcatgagctcaagcagtccgctcgccctggcctcctaaagtgtagggattataagcgtgagccactgcgcctggcctggggatcatgttttaacatgagaattagtggagacaaacacatgatatctaaataatagcaccatagtatacttgactagctttttaattattttttaaatatacaggaaggtaataagtaacaaagtaataatagtgaatagtttaagctcagttagcataatcgggcaaactttcatttgataaaagtgataagtagttttcagtggcttttttgtttaccagaaggaggtggtttttaaatacgtgcatccaagataaaatataaaaaaatgttcaggtttgctttcctacatagataaaataatatgtaactagctctcccaaatttcagcaacagttagtgaatgtttagccacaaatttgcagttaattatataatcagttcttaggattttatgaacaagttctatattctttgtgccttatacctagttgtaagcagtcattccacaattattttcctgaagtggcttggttaatgccacaccagaaacaggtcacagacaatagtgctgtaagaaatgtgtgaggaaagaggcacatgggaagtagctagctcgtgctggaggaactggaaaaaaacctcacatgggagatgacagttgagctgaattcttaactagagttgtaacagggcgaggcccttacatgcagaccacctgtgtggattaagataagacataaagtaatcttttaaaagaactattatttagaaacctggtatatgctacatggtgctgtgttatactgggtttgagaaagaatgggaagtgttacaaggattcagtggttggaaattaaggaagatagaaagttagtgttggatctgttttggctctttggtcatgcctttgtttttctcaaaatgaatgcagtgcccgtcccagaaaataccatatgagaagcgatttcataatgctgtgagagtctgttacagggacttgatcaagtctgagggccatgagagaaagtccctctgaggaagttgctttcaagctgacacctgaaggatgaagcagaattatcccagctgggatttgggaactggtgtttgaggctgaggactagcatgcatgataggaaaataacccagagtggcagaagtgggagtggtatgagatggcatcagagacgcagattcagggtcaaatcattcagagcctcctagaccatgtgaacacatgtattatgctgtggagatactgtttaataggcagtctgcttttttttctgcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcaggtaaggctggtaaggcctaactcttaatttttgtaccatataaaaaaacttttaatatggtaaagggattttcctttataatttttgcttttgtgtgatggtagggtagatagctaaggacttggggacccttttcaatatatattcgaaggttactgatgattgtaagaggttcagaggaaacagccaagaaagatttgagagtttacagctgtttctggaaatctggaaaccatggagttaaaaatcttaactaaagtctgcttggctctatttgcagtgttaatgtgctttctttattttttgtttgaacacagcatcctcatgtctatagtcctgtaatacagggtaatgctagaatgatggcaccaccaacacacgcccagcctggtttagtatcttcttcagcaactcagtacggggctcatgagcagacgcatgcgatgtatggtaggaagcactttgtttgtctcttccagtgtgtgtgactcttcttaatttaagtttctgaaaacatactctatctaagaataacctgaccttttatgacattgagggtcaagaatctgaaggaaaagatgaacccatttctttgcctgacttgctttataacttttggcaaatagtttctacttctgtacctggtcttcagatctctttcctgctttaactaaaatgtaatgatgtatataatggcaaagcatctttgtggagaaaggtacctttctcctcttcctcatcaatattatgctttggtatatcctgcctacgacatgcaagagaattttataataataaaagcataaaggtgttctccagcatgaaaacattttgcttcactacttgatctgagggtcactggcattacatattttttttgctgtttgttataatgataatactatgtttctacatcatgctgtattttaatggttgaatattatgtcatattagatatattttagacatgagtcacactttaaatataaccaatgtgaacagaatgctgaaatgaaaatgagaagtattttatgtaaaactaagcagtatttatatgtgagaataataagcaaaaaaacccatcttcgttttgtgactaaacagagaaatttgtgtagatcaacttagcagctgtctaaagtaccaaaataatagatttttcactgttgataatttaaaataaaatgtccatttgtatatcttatgatacagaattaatggattgcttcaaatgtttttcagaatatgtttttaaatagtactgatttcattaagatgttttgttctgaatatttctgagaactaccgtagtgtcgtttagttttcctatttgcgtttttggttgtttggagtaggggataattttggtttattcatacagttgaaaagtgtactgctatgagaatgagattatggttacatgtaactacatgggcatttcatttttaaagcctctttgaactttttgaaatactaagaatataaaatttttattttttaagtttagatgtcctgaacgagtatgtttaggcaaaattgagttatttaagaatttataggctgggcgcagtggctcacgcctgtaatcccagcactttgggaggccaaggctggcggatcatgaggtcaggagatcgagaccagcctggccaacatggtgaaaccccatctctactaaaaatccaaaaaattggccgggtgtggtggcatgtgcctgtagtcccggctacttcggaggctgaggcaacagaattgcttgaacccgggaggcagaggttgcagtgagccgagatcgcgccactacactctagcctgagcgacagagtgagactccatctccaaaaaaaaaaaaaaaaaaaaagaatttacagatttctggcaaaccttcttcttgagacattactacttttcataccacctctgtcctttttgaagaataaaagttttaacattccgtaggttaatgagaataggacttgggcagcagcaatcatccttcctgtcacctgtaacccacagcttatgctttcttcctggaggttcttgtctgccacaaaggctcactgctgataggaatttgtatatgatcaaaggtgtttagttttataaaacagttaagtccagtcttaattttccacattatcactttcaattttgtattgtggattacgcattttaaataaaaaattgtgtgattgctacattttggaaaacatttttttcaagaggcccatccgtaatttaattgtaaaagatactgacaaactaacttggtttattattttggttatgaccccgtcatttgacttgtctttagttgtcttaacggggactgaatatgcgtgcaaaggcacgattgatttatcatgctggcttttatgcaacttgtatatattttaacaattttcctgtttgctaaaggcttaggttaaaagttcattatgattgtttatacatttctggtgaatacatcatgatttaacaagtggaaagaacatctctttccttccattttctggcatactccccttggaatcagatctgaaacttttaagctaaaatttccattgcatttggagagtagttatttgtgtatgcatgcttttgagacattgtagcaataatactgtaatgttgagccgaatctttctcctcattgtgttcattcactgccaacatctggcttcatcttttggatgaatgttcattggttttgaaacagcctatagggtaaatactgtgtttgaggtacagatgattttcataactacttcctagaacatgtccatttgaagagcagtggggccttagaccccaaagtccatttatgtgtgggcaaataggaaatgttgcaaacaaaacaaagcactagatctaatgtccagtgaaatctggaatgaactagtcattagagccggttctttcatgccaggaaaaagttactcagccaaatctgaactactctcctgcagtttacacaggtggtatttaattgctgtctgtatggaggcaggctaggagcaaggctgtggacttgttgtgattgtcactagttaatcaagattccctttgtggtgcttaagaccctaaaaaggacactaggagctgggcatggtggctgacacctgtaatccaagaacttggggaggctgaagtggaggatcgcttagcccaggtgttcaagaccagtctaggcaagatggcgagatcccatctctaccaaaaaaaaaaaaaaaaaaaaaaaaaaaaagcccagtcatggtggcacatgcctgtagtcccacctacacaggaagctgagatgggaggatcacttgagtccaggactttgaggctacagtgagctatcatggcaccactgtaatccagcctgggtgacagagcaagaccctgtctctatttaaaaaaaagaaaacataagaaagaattgttttgttctatgccatcataagccataatttaatctgcttaagcatgttcttcattaaatctgcagtgatttatttgaattattagactttcaaagccttattatatcaaatataaacaaaatttgaagtacattcttataaactacaacaaacttacatagaagtgttaattttatactcatcttccctgaacaatttatattttataaatatattaaatatattgtaataaattttctcaaaggaaccaaatactttgagtatgaattgtgcttttctttttaagctacatcatatctaggtttttaaaacatttaatgcaaacagaagaacatgcacccagatgttggtgacaattttatgtcaccttttctcattcattaattgttatagccatagccaaaggcattgaaaacataggaccactaatgactgcaaaatgaaatcctgattattgtttttaaatttttagtatgtttaatacacatatgctaacattactgaacagttaaatgataaaataggataattattttattctaaaaaagtattgaccttgacctctttctagctatcttagaaagggcttttgtcaaaaaccttatctctttgatgtctctttttttgagatggagtctctccctgtcgcccaggctggagtgcagtggcgtgatctcagctcactgcacgctccgcctcctgcgttcacgccattctcctacctcagcctcccgagtagctaggactacaggcgcccgccaccatgcccggctaattttttgtattttgtttagtagagatggggtttcactgtgttagccaggatggtcttgatctcctgacctcgtgatccgcctgcctcagcctcccaaagtgctgggattacaggcgtgagccactgtgcccagcctctttttttttttttattttttatttattttttattttttttttaatttttgagaaggagtctccctctgccacccaggctggagtgcagtggcgcgatctcagctccctgcaaactccgcctcctgggttcaagcagttctcctgcctcagcctcctgagtagctgggactacaggtgcccgccaccacacctggctaatttttgtgtttttagtagagacagggtttcaccatgttggtcaggctggtcttgaattcccgacctcaggtgatccacccacctcagcctcccaaagtgctgggattacaggcgtgagccactgccccggcctctttgatgtctcttaatctaacttccatcattgcctctaccccatcccttctaagaagttactttaattttttttcctctcacatctactctttttttttttttttttttttttttgaggtagtctcactctgtcacccattctgaagtgcagcggtgcgatctcagctcactgcaacatctgcctcccaggttcaagcggtttttctgcctcagcctcccgagtaggtgggactacaggtgtgcgccaccacgaccggccaatttttgtatttttagtagagacggggtttcaccgtcttggccaggctgatctcgaacttctgaccttgtgatttgtctgcctaggcctcccaaagtgctgggattacagatgtgagccaccacgcccagcctcacatctactcttctaatccatctaattttgttttatggtgatgcttttacctttcagaaacagtaataatacaacttttccgactaactagagccattaggaagaattagatccagaatccttttttgatttgtttttggtagtttaatgcagataagtaagaaaatatagttaagttaaaaaaaaaaaaaatgaaaagcatccataatccctccacctgacaactgccttttaacattttgatgtgtatccttccaggtgtatttaaatacactcaaataccctacccctttatgtagacatgttttaataagaaataatattcatgtttatattcttgctatgatcctaaatttttggatccattactagataatctttcaggataatgacatttccattagtaatgtttttgcaaaattgtgtgtctattgaattaaacttgtaaaatagttttattttggtacatgatttatatcaaggttgttcagtagaatgccatgttggtgtttttattagataatgattttattccttttacttttaagcaagtcagcatgacaacttgacacctaagtacagaagaacagtgtcttccggtttagtcctttcttttaaaattctgtagcagtgtttaaagtgcttgtcatctcttatgaaaatgaattatgcatgaatacaaaaagaaattactaatatgtcaacctttccagaaaatttggaaaatgcacacctcaaaaggctaatttacctttctatttcccaaattcagcatgtcccaaattaccatacaacaaggagacaagcccttctttctactttgccagtgagttgggttttttatactaatttttaattgtacagtaaaacactttttaaaggatacatgttaagggagtagacttgttgaacaatattttccttgtgccagtcaaattattgaaagtacttatatatataaataattcagtttttaaaatggaaatacccaatttaagaaggctggagttaatgaaaaatggagttgtttcagaaatcaatttttgcataccaagcaaatgtgactgggaaatgcctaatattttccttgttagagaaacttcctaaacagctttatacacacacacacacacacacacacacacacacacaaacacacacacccaagccacaagcttggtataaatttaaaatgtttatttatacacacacacacacacacacacacacacacacacaccccaagccacaagcttggtataaacttaaaatgtttatttatattctgataagatgaaatttatgcctaccaggatttttaattgaataggattgatgaaatactaagggaaaaacttttcagtcctgtgcatggctaaaggtttaaaatactcaggaagggccaggcacggtggctcacacctgtaatcccagtgctttgggaggctgaggcgggtggatcatctgaggtcagcagttcaagaccagcctagccaacatggtaaaactccatctctactaaaaaatacaaaaatcagccatgcatgctggcatgcgcctataatctcagctactagggaggctgagacaggagaattgcttgaacttgggaggcagaggttgcagtgagccgaagtcgtgccactccactccagcctgggtggcagagcgaaattctgtctcaaaaaataaaatattcaggaagcagacccctcaggatatcttgagcttaagcaagagatcatgacctctcaggtcattatcttggacagcacaggtcccctctccccacctggcaaaaagtacagaaatagttgctccttcatggagaaagtctgggcagagctttcttctggaaatgaacttttaaggtacatttttcctatttgtagggcaatttgtaaaaataagggccggacgtggtggctcacgcctgtaatcccagtactttgggaggccgaggtgggtggattgcttgaggccaggagttcgagaacagcctggccaacatggtgaaaccctatctctaccaaagcatggtggcacgcacctgtagtcccagctacttgggaggcggaggcacaagagttccatgaaccctggaggtggaggttgcagtgagctgagattgtaccactgcactcaggcctgggcaacagagagagactctgtctcaaaataaaaaataaaaataaggctagtcttggactttggtatttaaataggaaggagtactaatatttgtagaaatcctttagaaatttgtgccattaatattgtcaccttgtatgaaatgttgtgttctagaggatattaaggattcaaattttatgttaggcacattttgagttattttggggtgactcaatgtctgactctactaaatgccatattagcatttaaaatgcatttgaccttaaatctttgttaattatgccatgacttggtatccaaaaataagctgatacatacatacatacatatatgtgtgtgtgtgtgtgtgtgtgtgtatatatatatatatgtatgtgtgtatatataatttatttggtgctaggaaatgttaaatttaatcctttaatagatgctctttaaaaaggagtcttgctgtatgtatatactattaaaggggaaactatgtctgtgattgtagtgtgtaaaagatagtaggtgattttattatgtactcaatttgaggtctcaaatgtagttatcctcaccatcttactgtctctgttagtagtttggtgttgttttcctggtaagtagctaaggtccttaatcattaacacctaagccttaattgccttagcacaacttcccctaaaagggagtatcagtactttttaaaagaaactaacagttgggctgctaatttaatctgctgcttcatttccccctgttctaagccattttatgatggtttggtcaagttgccttttattccccttttagagttttcaactttccttcacttccctttttctgaatttaacatcagatttacaagttggaagattttgttttgttttataagttttgcaatgctggtgatctcttatgacttgtgcatccaaagtcaaaatgacaaaacctagttacaaattaaacacacagctttctgtacttaatttgcttcagtgagatcacagctgaggaaactagttctggaatgtggttagtgttattaaggatttttgactgatcatatgtttagaatcttaaatatttatgtcaaggaacactgagtgggaaacttctggactaggtctggaccaaagaagcatatgtctttgattatctttaatctaaaagattttatgaagactaaagttttataaatagaagtttaactgatgaataaatcagtattacaaataaaattaactttatttttaacctctctgggatctttagccagaatgagcatatataacaaaagcagtgaaataatatgtgtgggtcagaacccactgcccttcccactccactctccttttccctgattctcctgtgttttttccttctttaccttatcttggttcctttttttttttttttcttttgagatggagtctcactctgtcgtccaggctggagtgcagtggtgcgatctcggctcactgcaacctccgcctcctaggttcaagcaattctctgcctcagcttccagagtagctgggattacaggcgcctgctgccacacccagctaattttttttgtatttttagtagagacagggtttcaccatcttggccaggctggtcttgaactcctgacctcgtgatcacctacctcggcccctggttccttttttgtctctcttgtcttccaagctatttttttccttggcttttaaattttcttcctaccctgctttgtgtcactgtcacttaactggcctatcaaggaaccgaactgtatttttgttactagtattgatttaaagtataagtttcacatttctcccaatttattattattatttatttatttatttgtttattttattttttgagacggagtttcgctcttgttgcccaagctggagtgcaatggtgtgatgtcggttcactgcaacctccacctcccgggttcaagctattctccttccccactctccctagtagctgtgattacaggtgcctgccaccacgcccagctaatttttgtatttttagtagagacagggtttcgccgtgttggccaagctggtctcgaactcctaacctcaggtgatccgcccgcctcggcctcccaaaatgctgggattacaagcgtgagccaccgtgcccggctccatttctcccaatttcaaattcaaggaggaaaagaattcctgattaaggtacttctttcagatcttttgagctagaacaaaaaaacaaagggaaatatttctaattaactctttttaaattttgtttacaacgtatgatacatattttacacatcctttgtggtttttgttcgtcttgtttttaatcaatgccttgcaagtttaccggtatttaggtagggaaaggattttgtttttgtttttttaaacaaagcctatgtacattcactcagcttgggtatttgtgctatgcatgcaaattagctatagattagaaaaccgtattatagtctttaaatactggtaaacttaaattgcagagatgccttttaaaaatgcatagtaaaaatatttcatctttacttttctcttcaaatgattttaagatttttacatttttccagttgatgaataacttaaattatgagatttcatgggcataattattttctatatttattgttactttttaatattcttaatactttgcttagaaggtatttaaaagtgaaatttcaaactttttagtacaaaatttcttgaataaataaagttacaaaaaaaaaacaaaaacctctgagattccgtactgtatctttatgaacctccatgaacagaatttgggatttgggaattgcttttccttagacagatttagattgttacaaatgacatttttaagaggctggggtggcggtaggggttagtgctaatggtttaacagtaggggaccatggacaactgtagacatcactatccagtagaacattttgtggctgggcgcggtggctcacgcctgtagtcccagcactttgggaggccaagacaagtggatcacctgaggtcaggagttcaagaccagccagaccaacatggtgaaaccctgtctctactaaaaatacaaaaaagttagccaggcgcgcctgtagtcctagctactcaggaggctgacacaggagaatcgcttgaacccgggaggcagaggttgcggtgagctgatatcacgccactgcactccaccctgggcaacagagcgagactccgtctcaaaacaacaacaaaactgcactgtccaccgtattagctacttagctacatgtggcttttttattattcaaaaataaatttttaggccgggtgcagttgctcacacctgtaatcccaacactttgggaggccgagatggacggatcacttgaggccaggagtttgagaccagcctggccaacatggtgaaaccccgtctctactaaaaatacaaaaattagccaggtaatcccagctactcagaggctgaagcaggagtatcactttaacccaggaggcggaggctgcagtgagccgagatcgctccactgcactccagcctgggtgacagcaagactgggtctcaaaaataaacaaacatggccgggcgcagtggctcatgcctgtaatcccagcactttgggaggccgaggcggatggatcacttgaggccagtagttcgagaccagcctggccaacatggtgaaacccgtctctactaaaaatacaaaaatcagccaggcatggtgatgcttgcctatagttccagctactcggcaggctgaggcaggagaatcgcttgaacccgggaggcggaggttgcagtgagccgagatggtgcccctgcactccagcctgggcaacagagcgagactctgtcaaaaattaaacaaataaatacatttttaaaatgaacgtaagatttttacaagtacaacaaactcaggttcgaaatttacatcaaatcttttagaccaagtcagtgcctatacaacttggaggagctggaagtaaacttaatgagtatgatgatgatggagggcctgttaataagccaccaagttagaaaaaaaggactgtcttatagacttatgggactgtgaagctcaggaaggcttcatcgtttgtacatcatttgttctagctcccagaagacgttcactactcttaaaaacattcagagactatgttgccacagttttcttgttaaaatattctggcatatgttaattcctacagtctggaaaattttcccagtgtataaacaaagctgctgtatccagtctaaactggatatgaaggaatattaatgccagctgtggcattggcagtggatgcacaggtgatcctagaactggctctttgccttgccctttcccctgctaagagatagctttgcagctggagacgtaactgttagggctggagagttggtggcccttagccctacaacacctaggattatagaactgctccatgtgcctagcctaaccctctgcacaccatttacgtggaatatacccagagccgtctatgctggtgactcggcagccttgcctaccagactgctggaactagggtgcctcttcccaaagctgtgcttgcttctctcaccaatcagtcctgcatatgtctgtgtttgctaacacgttatatgaagaatgtggggaactattttggaatcatttctgtgtatgggcttattatcttgagggattttaggatttgtttctcaagagagggctgggaactataccttgctagagttgtcttgagaacgctctattctcagctcattgcctcgtggaggttagttttttatcatcggtgtgctgtccatagtcactggaagcagtgaacacatcctactctgcttctgattctcaacttactgtttttgaagcacatgaacaggccaggcacggtggctcacgtctgtaatcccagcactttgggaggctgaagtgggcggatcatttgaggtcaggagtttgagatcagcctggccagcatggcgaaaccccatctctactaaaaatacaaaaattagctgggcgtggtggcacatgcctgtaatctcagctactcgggaggctgaggcaggagaattgcttgaacctgggaggcagaggttgcagtgagcctgggcaacagagtgagtgagacttatatctcaaaaaaaaacaaaaaacaaaaaactgaaagacatgaagaaatggtttttgtaccaaggtttggcccacgctgagattcacaaagaactggctttcagttcttatctttattttgatttaaactggcccatcatgttgtcctttgaagttagtctagtaaatttctttccaaagggctggggcactcagaagggagtttacttttctatatttatttcataaagcaaagatgggagatcctccattagggcttgggaaagtaaactgagtggcagaagggctcctgtgattagctgagagagactgtggtccttcggccctgatgatagatccctggccttgccacataccatacacagtgcccgcacccccatcccccaccacacccaatatagtctgtgccctcaggacattgctccagggcagtagcatggtgaggttagcctgatgatggccttgagctaaagagtgtgcacctaaaatgcacttgtttgagtagtttctgcctatgccttcaagttgcctttttgggaaaacctagtgaccgttaagagtaaatgcaaactaatttgattttaatatcatatgtagagctgtattatatgaaccaaatgctagtctgttaagcaatagctacacttattttttcaagacaatggatggtttaaatggagtcatctatagaaattggtagtggcgtgagttatgcattgtaaccatcaagaaagttcagttgatgaagtgtagaggagcgatggaggttgtcagacatcggttgtgtacatgctcctttttctttcactttagtttccacgggctcccttgctcagcagtatgcgcaccctaacgctaccctgcacccacatactccacaccctcagccttcagctacccccactggacagcagcaaagccaacatggtggaagtcatcctgcacccagtcctgttcaggtaagggcaactcagaggtctgcatggagtggcttctttatcctagtatctgagtgctttcttcaggtgccaggtatcgcatcgtcagaacacatggcatgtccaccctcgtgaagatggatacagctgtgcccctggggtggtggttttaagaatcacatttaaaggctgggcgcagtggctcacgcctgtaatcccaccactttgggaggccgaggcgggtggatcacgaggtcaggagattgagaccatcctggcgaacactgtgaaactccgtctctaataaaaatacaaaaaaattagccgggcgtggtggtgggcgcctgtagtcccagcttctcgggaggctgaggaaggagaatggcgtgaacccgggaggcggagcttgcagtgagcagagatcgcgccactgcactccagcttggacaacagcgagactctgtctcaaaaaaataaaaaattaaaaaaaatcacatttaagatacatgttgataataaggtgattggataagctctggaaacttgcagtaatgaaaaatcaaatttaacataaagttcataaggcaaattcctatttgcttgggactttttaatttctaaggtttatgtgatgaggttattttcctatgagcttcttgaattatgtttgctaatggaggcagttaaagatgtctttgatatctatcagttccctggggcagtagtcttttttgactttagtatgtatgctcagaagtttctaactgccagactgagaatcaggcttctgtaccctagaaaggagttgtccagatgggaggcacctccagccttgctcttaccaccctgtacattctcctgtactttccagtgaccctcatcataggcccaagtgtgcaaagcttagctttgtgggtatcccttggctgcttttcattaaagaagttttcctctcaattctttcctgtcgctttgcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggtaataccagctttagccaactttctgtgaaggccaagtagaatgtgaaggttatcagtaagcagctagaggctctcccagctaggaaaccctgtgtgtcatgccatttgcctgtctccctttccctctcaaatacacgtgatctggccctaagggaatgtttgtgtggttttgtcatgggatcagtgaaggtgctgattggtcagtcctttagttttccaactgagaccttaaaaatatctttgactctggaatgcaacccagtccttctttcctttctgtgtctgctttgctatgtctatatagcctcactactatatatatgtgtacatatatattcccctacacacttaccttggaagccaggcagggatgatggccttcacagagtctcagctctccgaagtgactaccggggcctgtcaacttgattgttactcacatgagttccagacacatctctccaattgttttccctggttatccatatatctgctttgaccataagttgtactcttgagagggcttggccttggacattggtgcagtgtaactagaagctggaagcacccaggtggtcccatttttctttaagagcagccctggaagcactttggagctcacctccagtgtaagctgctacaggtgaaaggtgtgcttgccatctcagtggttgctgtctgcatcagctgctgacaaaggtccctgcactccagggcccaggggattgtcttaatgaggagaaggagctgcactgaagttgggctctaacgctggccttgaggccctccctggggctgttacgggtgaattggctgtattagatgtctctgctactttcataacagaactctctgaggcgggtctaagtgagacctgccacaatgaattccatttcctgttaaatagtgcgccagtgaggctctggcaaggtgtgggctagagatgcgactcagttggatctatctctcagaaggctaccttgtaagtagagttccacagctctgggaagtttgggcgtcctcaccctgcaaagtttaggttctgtggtgtagcgcactgcagttgatttgctttttgatagtggggagggaagccggtttggtccgtgtgggccagcgtggtttggtggagtcagcttcataagagctggggtcctgtaggtgtctaccagaggctggtggctaagtaggcatgtgaacttacatgtaagtcagggatccctaaaacctcactctgtttttgtgctgaaagggcaaaaaggttaacacagggaagctcaaatttgccatgtgcccgtttgaatatgtgagagtaaaaacggcatttcatccaaggcttatcgtagtctagaacagtgcacagtgtgggaaaaaggaaacaagggctcttcctggccctgccaaccccctgcagagctggaatccagctgtttgggctgactaaaatcacctttccaacttgacagtgagtgagaccaggttgaacttggtacagagacgctgggctggcccagatgacttcaggttactcctttccatctcactggagccattaaaaactccaactcctcctcctcctcctgctccatcagcatatctctgagagagtcacgggggcctaagagtctcttttcactgcctggtgagcagaccagaagcagagggagagaggcaaatgaacagaggtccaagtaattcacatacttgactgtgacagtctctgcttattaatgtaatctgttttcctatttgaaagggatgttatctgcaaaactacctcaggccccacatggcagcctgattctgaagcatcattgaatcttgtatgatattaagttgagaaagctgcccttggatccagtgtctaatctttgtgaagatcttaccccatacatagaatacaatgatcagaaatgtcaagggttaggacagcacagccctgacttctacccaggctcacttgttgcctgctccctgacccttgcaggatctgcccaaaggtgaagcgcgtcttcaggtcaatagataatctactagagattgtccccagagaacagaactgggccctgaggcccaccgttgccctttcctgagagtcccagcccagtgaaaggaacacagttgacatgttgttgaagccggagatgttgcctgtatgcgtaaaagagctctctgtttcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcaggtgaggcgtgtgtgtgcaggggccgccggggcaccccaaagcattctgctcgcacaggtggaatggcaggcagggccagtgcttcaagccccgcatttgagaactagcaagacccgtccaggagtgtgcacaggagggactgtgacgatcagttcagcatcagggcctgaggcttccgggagccgagtctgtgtgtgttctgatggtatacaggatttggcttgatgagaagcagcagcagcagcaacagcagcctgatgcatgcctaggactcagttggccttccttgttatgacaggctggacagggcagtgttttccttcctgagtcccaaaagtctgacatgtggggggttattaccatggcagagtttgattgtagctctggagaagatactgctgagaaagcgctgtggatggactggctttgagtgtagcgttagccccagcccctgaacaggggagagcgccctgtgattgtgctctactacttgatggctgccatggcgatacttcacagtctgacctgttattctgaaagcaatactggtgcttggctaatatttggggagggggtttgttaaggcctttttttctaccccatgaacaagtcttctgggagttttatctgaagtggttttacgtctgactggtttgtttctacccacccacccaaccctccccactttggtgcagatgggagggggaaaagcgaattcaattttgagttttgttcagctagcacgaggatagtttacaatcatgtgctgcagagacactaggctgatgtgtggtgttgccagttttctgtttcaatgttcgcttttctttttacagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgatcaagttagtgtgtgtctgtataagctacttctttgtaggatacttaatatcaaagcaggtgtgctaagggtgcattttgaatatcccggaaggtagctgtgaaatgatttttcttcttcacccttagttctggttcaaggtatctctagaaaaagacaagactgagctattctctttggtggattagagatctgcttcaggaggaggaaggttggccagagttgggcagcactgaaattccacatcctcgggctgacaccgattctgtaagcttcctttttaatatctcctgaaccaaaatgagtgtcattagctggaagttcccaattcgggcatttttctactttaccagtagggggcaggagacactcagaaaaaaattgcaataaagaaatccagagggcatgaaggctgaaaagatacaaagatgtacaaagctgcttattgacatggatggactcataagcatttgttagtattcccagattgcaacggggaggacaaagggaagagcgagtatttgggcagggcaaggattttgtagagacaccatggtcttaatagagcctttaaatattatgacagcaaatcaagattctgaaaactttttaattcacatatagcaatttgtacattatagcaaaatttgcattattcaagaataagttacttgtacagtacataaaacaatacataaaaatttgccaaataccttctgcctataatgatacaagatgaatccactttatgttatcacaatgtgctgtatattctaaccaaacacaggatgtcagatgtgtccttgttaatatactcgcaagttcctctagcttgtgggagatgttagagctaacacatttgcagtaagggacttagtcctgaatagaaagcatgaaggaatctcaggcaaccctcagggaagagtccaaggccttgactttaggttaagaaactgttatgtaaaaatagtgttctctggcccaagattttaatgattgctattcctttttcctacggtccagaaatgatcaaaggcagaagatttataccagataaagccatatggattgctggtctaaaattcaaggcaggttagttgacttaattctttggtgctggtgactgttagtttgtaaaagttcaataagtcagatgaaggaagggatggtgccgggagctgtcaagctgtactggtggggtctgtaattagagctaactggagggatcatgatgtctactgtccagtttggtgttgagccatggctctcggtagaagttgccggctggggcctggtcaggactggaaggagagtggtgggatgtgctgtgcctatggtgggctagctgcagccagtggggtgcctgccccacactgctgcccaccccttcatcagctgattctgctcccacataaagaaaggtgttggcttagtgtcacttcttcctagagccatgggagttttctgtcagcatgtttttgagctgtcctggtaacttggacgggaagcagtctggaggtgggtgccttccaaatctctgccacagaa

SEQ ID NO: 3-9 - skipped (7 entries)

SEQ ID NO: 10 - DNA, 26 bp, Artificial sequence
  Primer
atatggactccagttatgcaaaaaga

SEQ ID NO: 11 - DNA, 22 bp, Artificial sequence
  Primer
tcgccattcactttagcactga

SEQ ID NO: 12 - DNA, 19 bp, Artificial sequence
  Probe
atgcttttactgactctgc

SEQ ID NO: 13 - DNA, 20 bp, Artificial sequence
  Primer
ctacagtcctcagcagttcc

SEQ ID NO: 14 - DNA, 22 bp, Artificial sequence
  Primer
gccatcattctagcattaccct

SEQ ID NO: 15 - DNA, 23 bp, Artificial sequence
  Probe
atcagccccttgttcagcatgtg

SEQ ID NO: 16 - DNA, 19 bp, Artificial sequence
  Primer
tccagtagcaaggaccagt

SEQ ID NO: 17 - DNA, 22 bp, Artificial sequence
  Primer
caatactgttctgtctgggaga

SEQ ID NO: 18 - DNA, 24 bp, Artificial sequence
  Probe
actgaccactgatgaccacgttcc

SEQ ID NO: 19-29 - skipped (11 entries)

SEQ ID NO: 30 - DNA, 20 bp, Artificial sequence
  Synthetic oligonucleotide
gattccatcaaaagaaatcg

SEQ ID NO: 31 - DNA, 20 bp, Artificial sequence
  Synthetic oligonucleotide
cgaactggattctgtacttt

SEQ ID NO: 32 - DNA, 20 bp, Artificial sequence
  Synthetic oligonucleotide
gctaactggtttgcccttgc

SEQ ID NO: 33 - DNA, 20 bp, Artificial sequence
  Synthetic oligonucleotide
ctctccattatttcttcacg

SEQ ID NO: 34 - DNA, 20 bp, Artificial sequence
  Synthetic oligonucleotide
cgggcggcggctgctgctgc

SEQ ID NO: 35 - DNA, 20 bp, Artificial sequence
  Synthetic oligonucleotide
cagccgcgggcggcggctgc

SEQ ID NO: 36 - DNA, 20 bp, Artificial sequence
  Synthetic oligonucleotide
cattggcagccgcgggcggc

SEQ ID NO: 37 - DNA, 20 bp, Artificial sequence
  Synthetic oligonucleotide
tgcggacattggcagccgcg

SEQ ID NO: 38 - DNA, 20 bp, Artificial sequence
  Synthetic oligonucleotide
cgggcttgcggacattggca

SEQ ID NO: 39 - DNA, 20 bp, Artificial sequence
  Synthetic oligonucleotide
tgccgccgggcttgcggaca

SEQ ID NO: 40 - DNA, 20 bp, Artificial sequence
  Synthetic oligonucleotide
ctagaaggccgctgccgccg

SEQ ID NO: 41 - DNA, 20 bp, Artificial sequence
  Synthetic oligonucleotide
ggcgcggcggcgggcgacgc

SEQ ID NO: 42 - DNA, 20 bp, Artificial sequence
  Synthetic oligonucleotide
ggcgaaggcgcggcggcggg

SEQ ID NO: 43 - DNA, 20 bp, Artificial sequence
  Synthetic oligonucleotide
gaggacggcgaaggcgcggc

SEQ ID NO: 44 - DNA, 20 bp, Artificial sequence
  Synthetic oligonucleotide
gaggacgaggacggcgaagg

SEQ ID NO: 45 - DNA, 20 bp, Artificial sequence
  Synthetic oligonucleotide
gagaccgaggacgaggacgg

SEQ ID NO: 46 - DNA, 20 bp, Artificial sequence
  Synthetic oligonucleotide
gacgaggagaccgaggacga

SEQ ID NO: 47 - DNA, 20 bp, Artificial sequence
  Synthetic oligonucleotide
gccgaggacgaggagaccga

SEQ ID NO: 48 - DNA, 20 bp, Artificial sequence
  Synthetic oligonucleotide
gccgtggccgaggacgagga

SEQ ID NO: 49 - DNA, 20 bp, Artificial sequence
  Synthetic oligonucleotide
gagggagccgtggccgagga

SEQ ID NO: 50 - DNA, 20 bp, Artificial sequence
  Synthetic oligonucleotide
accgaggagggagccgtggc

SEQ ID NO: 51 - DNA, 20 bp, Artificial sequence
  Synthetic oligonucleotide
gcgaccaccgaggagggagc

SEQ ID NO: 52 - DNA, 20 bp, Artificial sequence
  Synthetic oligonucleotide
gtcgccgcgaccaccgagga

SEQ ID NO: 53 - DNA, 20 bp, Artificial sequence
  Synthetic oligonucleotide
ccggaggtcgccgcgaccac

SEQ ID NO: 54 - DNA, 20 bp, Artificial sequence
  Synthetic oligonucleotide
ccgccgccggaggtcgccgc

SEQ ID NO: 55 - DNA, 20 bp, Artificial sequence
  Synthetic oligonucleotide
ggcctcccgccgccggaggt

SEQ ID NO: 56 - DNA, 20 bp, Artificial sequence
  Synthetic oligonucleotide
aggccgggcctcccgccgcc

SEQ ID NO: 57 - DNA, 20 bp, Artificial sequence
  Synthetic oligonucleotide
ctgcccaggccgggcctccc

SEQ ID NO: 58 - DNA, 20 bp, Artificial sequence
  Synthetic oligonucleotide
cgacctctgcccaggccggg

SEQ ID NO: 59 - DNA, 20 bp, Artificial sequence
  Synthetic oligonucleotide
ctgtttcgacctctgcccag

SEQ ID NO: 60 - DNA, 20 bp, Artificial sequence
  Synthetic oligonucleotide
ttgttactgtttcgacctct

SEQ ID NO: 61 - DNA, 20 bp, Artificial sequence
  Synthetic oligonucleotide
agtcctttgttactgtttcg

SEQ ID NO: 62 - DNA, 20 bp, Artificial sequence
  Synthetic oligonucleotide
tgaggcagtcctttgttact

SEQ ID NO: 63 - DNA, 20 bp, Artificial sequence
  Synthetic oligonucleotide
gtagactgaggcagtccttt

SEQ ID NO: 64 - DNA, 20 bp, Artificial sequence
  Synthetic oligonucleotide
agattccatcaaaagaaatc

SEQ ID NO: 65 - DNA, 20 bp, Artificial sequence
  Synthetic oligonucleotide
atagattccatcaaaagaaa

SEQ ID NO: 66 - DNA, 20 bp, Artificial sequence
  Synthetic oligonucleotide
gcatagattccatcaaaaga

SEQ ID NO: 67 - DNA, 20 bp, Artificial sequence
  Synthetic oligonucleotide
tgcatagattccatcaaaag

SEQ ID NO: 68 - DNA, 20 bp, Artificial sequence
  Synthetic oligonucleotide
ttgcatagattccatcaaaa

SEQ ID NO: 69 - DNA, 20 bp, Artificial sequence
  Synthetic oligonucleotide
atttgcatagattccatcaa

SEQ ID NO: 70 - DNA, 20 bp, Artificial sequence
  Synthetic oligonucleotide
atatttgcatagattccatc

SEQ ID NO: 71 - DNA, 20 bp, Artificial sequence
  Synthetic oligonucleotide
catatttgcatagattccat

SEQ ID NO: 72 - DNA, 20 bp, Artificial sequence
  Synthetic oligonucleotide
catcctcatatttgcataga

SEQ ID NO: 73 - DNA, 20 bp, Artificial sequence
  Synthetic oligonucleotide
atgaaccatcctcatatttg

SEQ ID NO: 74 - DNA, 20 bp, Artificial sequence
  Synthetic oligonucleotide
aagtatatgaaccatcctca

SEQ ID NO: 75 - DNA, 20 bp, Artificial sequence
  Synthetic oligonucleotide
tgatgtaagtatatgaacca

SEQ ID NO: 76 - DNA, 20 bp, Artificial sequence
  Synthetic oligonucleotide
aacaactgatgtaagtatat

SEQ ID NO: 77 - DNA, 20 bp, Artificial sequence
  Synthetic oligonucleotide
ttggagccaacaactgatgt

SEQ ID NO: 78 - DNA, 20 bp, Artificial sequence
  Synthetic oligonucleotide
ttcacatttggagccaacaa

SEQ ID NO: 79 - DNA, 20 bp, Artificial sequence
  Synthetic oligonucleotide
ttgtacttcacatttggagc

SEQ ID NO: 80 - DNA, 20 bp, Artificial sequence
  Synthetic oligonucleotide
tttcacttgtacttcacatt

SEQ ID NO: 81 - DNA, 20 bp, Artificial sequence
  Synthetic oligonucleotide
tccatttttcacttgtactt

SEQ ID NO: 82 - DNA, 20 bp, Artificial sequence
  Synthetic oligonucleotide
tatacctccatttttcactt

SEQ ID NO: 83 - DNA, 20 bp, Artificial sequence
  Synthetic oligonucleotide
ttcatatatacctccatttt

SEQ ID NO: 84 - DNA, 20 bp, Artificial sequence
  Synthetic oligonucleotide
aactccttcatatatacctc

SEQ ID NO: 85 - DNA, 20 bp, Artificial sequence
  Synthetic oligonucleotide
tttaaaaactccttcatata

SEQ ID NO: 86 - DNA, 20 bp, Artificial sequence
  Synthetic oligonucleotide
gtaagttttaaaaactcctt

SEQ ID NO: 87 - DNA, 20 bp, Artificial sequence
  Synthetic oligonucleotide
cggactgtaagttttaaaaa

SEQ ID NO: 88 - DNA, 20 bp, Artificial sequence
  Synthetic oligonucleotide
acacttcggactgtaagttt

SEQ ID NO: 89 - DNA, 20 bp, Artificial sequence
  Synthetic oligonucleotide
caaatcacacttcggactgt

SEQ ID NO: 90 - DNA, 20 bp, Artificial sequence
  Synthetic oligonucleotide
aagtaccaaatcacacttcg

SEQ ID NO: 91 - DNA, 20 bp, Artificial sequence
  Synthetic oligonucleotide
ggcatcaagtaccaaatcac

SEQ ID NO: 92 - DNA, 20 bp, Artificial sequence
  Synthetic oligonucleotide
atgtgcggcatcaagtacca

SEQ ID NO: 93 - DNA, 20 bp, Artificial sequence
  Synthetic oligonucleotide
tttctcatgtgcggcatcaa

SEQ ID NO: 94 - DNA, 20 bp, Artificial sequence
  Synthetic oligonucleotide
tgtacttttctcatgtgcgg

SEQ ID NO: 95 - DNA, 20 bp, Artificial sequence
  Synthetic oligonucleotide
ggattctgtacttttctcat

SEQ ID NO: 96 - DNA, 20 bp, Artificial sequence
  Synthetic oligonucleotide
cggccccgaactggattctg

SEQ ID NO: 97 - DNA, 20 bp, Artificial sequence
  Synthetic oligonucleotide
actctccattatttcttcac

SEQ ID NO: 98 - DNA, 20 bp, Artificial sequence
  Synthetic oligonucleotide
atactctccattatttcttc

SEQ ID NO: 99 - DNA, 20 bp, Artificial sequence
  Synthetic oligonucleotide
aaatactctccattatttct

SEQ ID NO: 100 - DNA, 20 bp, Artificial sequence
  Synthetic oligonucleotide
aaaatactctccattatttc

SEQ ID NO: 101 - DNA, 20 bp, Artificial sequence
  Synthetic oligonucleotide
ttgaacaaaatactctccat

SEQ ID NO: 102 - DNA, 20 bp, Artificial sequence
  Synthetic oligonucleotide
gaacatttgaacaaaatact

SEQ ID NO: 103 - DNA, 20 bp, Artificial sequence
  Synthetic oligonucleotide
aagtctgaacatttgaacaa

SEQ ID NO: 104 - DNA, 20 bp, Artificial sequence
  Synthetic oligonucleotide
acaacaaagtctgaacattt

SEQ ID NO: 105 - DNA, 20 bp, Artificial sequence
  Synthetic oligonucleotide
tgtaccacaacaaagtctga

SEQ ID NO: 106 - DNA, 20 bp, Artificial sequence
  Synthetic oligonucleotide
atatctttaaactgtaccac

SEQ ID NO: 107 - DNA, 20 bp, Artificial sequence
  Synthetic oligonucleotide
gagtccatatctttaaactg

SEQ ID NO: 108 - DNA, 20 bp, Artificial sequence
  Synthetic oligonucleotide
tgctaactggtttgcccttg

SEQ ID NO: 109 - DNA, 20 bp, Artificial sequence
  Synthetic oligonucleotide
tctgctaactggtttgccct

SEQ ID NO: 110 - DNA, 20 bp, Artificial sequence
  Synthetic oligonucleotide
cttctgctaactggtttgcc

SEQ ID NO: 111 - DNA, 20 bp, Artificial sequence
  Synthetic oligonucleotide
tgctgtgtatttttcttcct

SEQ ID NO: 112 - DNA, 20 bp, Artificial sequence
  Synthetic oligonucleotide
cccatacgcggtgaattctg

SEQ ID NO: 113 - DNA, 20 bp, Artificial sequence
  Synthetic oligonucleotide
taactggagtccatatcttt

SEQ ID NO: 114 - DNA, 20 bp, Artificial sequence
  Synthetic oligonucleotide
tttgcataactggagtccat

SEQ ID NO: 115 - DNA, 20 bp, Artificial sequence
  Synthetic oligonucleotide
tctctttttgcataactgga

SEQ ID NO: 116 - DNA, 20 bp, Artificial sequence
  Synthetic oligonucleotide
aaagcatctctttttgcata

SEQ ID NO: 117 - DNA, 20 bp, Artificial sequence
  Synthetic oligonucleotide
tcagtaaaagcatctctttt

SEQ ID NO: 118 - DNA, 20 bp, Artificial sequence
  Synthetic oligonucleotide
gcagagtcagtaaaagcatc

SEQ ID NO: 119 - DNA, 20 bp, Artificial sequence
  Synthetic oligonucleotide
ctgatagcagagtcagtaaa

SEQ ID NO: 120 - DNA, 20 bp, Artificial sequence
  Synthetic oligonucleotide
ttagcactgatagcagagtc

SEQ ID NO: 121 - DNA, 20 bp, Artificial sequence
  Synthetic oligonucleotide
ttcactttagcactgatagc

SEQ ID NO: 122 - DNA, 20 bp, Artificial sequence
  Synthetic oligonucleotide
tcgccattcactttagcact

SEQ ID NO: 123 - DNA, 20 bp, Artificial sequence
  Synthetic oligonucleotide
tccaggtccttctctttgtg

SEQ ID NO: 124 - DNA, 20 bp, Artificial sequence
  Synthetic oligonucleotide
cagggctccaggtccttctc

SEQ ID NO: 125 - DNA, 20 bp, Artificial sequence
  Synthetic oligonucleotide
gcatcccagggctccaggtc

SEQ ID NO: 126 - DNA, 20 bp, Artificial sequence
  Synthetic oligonucleotide
tcacctgcatcccagggctc

SEQ ID NO: 127 - DNA, 20 bp, Artificial sequence
  Synthetic oligonucleotide
gtgagttcacctgcatccca

SEQ ID NO: 128 - DNA, 20 bp, Artificial sequence
  Synthetic oligonucleotide
ttggctgtgagttcacctgc

SEQ ID NO: 129 - DNA, 20 bp, Artificial sequence
  Synthetic oligonucleotide
tcctcattggctgtgagttc

SEQ ID NO: 130 - DNA, 20 bp, Artificial sequence
  Synthetic oligonucleotide
tcaagttcctcattggctgt

SEQ ID NO: 131 - DNA, 20 bp, Artificial sequence
  Synthetic oligonucleotide
ttttccaaagcctcaagttc

SEQ ID NO: 132 - DNA, 20 bp, Artificial sequence
  Synthetic oligonucleotide
gatcccatccattagatacg

SEQ ID NO: 133 - DNA, 20 bp, Artificial sequence
  Synthetic oligonucleotide
gaaacatatcattgggatcc

SEQ ID NO: 134 - DNA, 20 bp, Artificial sequence
  Synthetic oligonucleotide
tatatcgaaacatatcattg

SEQ ID NO: 135 - DNA, 20 bp, Artificial sequence
  Synthetic oligonucleotide
cttcattatatcgaaacata

SEQ ID NO: 136 - DNA, 20 bp, Artificial sequence
  Synthetic oligonucleotide
aattttcttcattatatcga

SEQ ID NO: 137 - DNA, 20 bp, Artificial sequence
  Synthetic oligonucleotide
caccataattttcttcatta

SEQ ID NO: 138 - DNA, 20 bp, Artificial sequence
  Synthetic oligonucleotide
acactacaccataattttct

SEQ ID NO: 139 - DNA, 20 bp, Artificial sequence
  Synthetic oligonucleotide
tgtatacgaagataaactgc

SEQ ID NO: 140 - DNA, 20 bp, Artificial sequence
  Synthetic oligonucleotide
atctctttctaagggcactg

SEQ ID NO: 141 - DNA, 20 bp, Artificial sequence
  Synthetic oligonucleotide
ttcttctgagttatctcttt

SEQ ID NO: 142 - DNA, 20 bp, Artificial sequence
  Synthetic oligonucleotide
taaaaattcttctgagttat

SEQ ID NO: 143 - DNA, 20 bp, Artificial sequence
  Synthetic oligonucleotide
ccgttttaaaaattcttctg

SEQ ID NO: 144 - DNA, 20 bp, Artificial sequence
  Synthetic oligonucleotide
tgcttcccgttttaaaaatt

SEQ ID NO: 145 - DNA, 20 bp, Artificial sequence
  Synthetic oligonucleotide
tgcccttgcttcccgtttta

SEQ ID NO: 146 - DNA, 20 bp, Artificial sequence
  Synthetic oligonucleotide
ctggtttgcccttgcttccc

SEQ ID NO: 147 - DNA, 20 bp, Artificial sequence
  Synthetic oligonucleotide
aactggtttgcccttgcttc

SEQ ID NO: 148 - DNA, 20 bp, Artificial sequence
  Synthetic oligonucleotide
ctaactggtttgcccttgct

SEQ ID NO: 149 - DNA, 20 bp, Artificial sequence
  Synthetic oligonucleotide
ttcttctgctaactggtttg

SEQ ID NO: 150 - DNA, 20 bp, Artificial sequence
  Synthetic oligonucleotide
ctcaatttcttctgctaact

SEQ ID NO: 151 - DNA, 20 bp, Artificial sequence
  Synthetic oligonucleotide
acttgactcaatttcttctg

SEQ ID NO: 152 - DNA, 20 bp, Artificial sequence
  Synthetic oligonucleotide
ctgggcacttgactcaattt

SEQ ID NO: 153 - DNA, 20 bp, Artificial sequence
  Synthetic oligonucleotide
tttgtactgggcacttgact

SEQ ID NO: 154 - DNA, 20 bp, Artificial sequence
  Synthetic oligonucleotide
tcgagctttgtactgggcac

SEQ ID NO: 155 - DNA, 20 bp, Artificial sequence
  Synthetic oligonucleotide
ggccactcgagctttgtact

SEQ ID NO: 156 - DNA, 20 bp, Artificial sequence
  Synthetic oligonucleotide
ttccagggccactcgagctt

SEQ ID NO: 157 - DNA, 20 bp, Artificial sequence
  Synthetic oligonucleotide
atcattttccagggccactc

SEQ ID NO: 158 - DNA, 20 bp, Artificial sequence
  Synthetic oligonucleotide
cctatcatcattttccaggg

SEQ ID NO: 159 - DNA, 20 bp, Artificial sequence
  Synthetic oligonucleotide
ctcactcctatcatcatttt

SEQ ID NO: 160 - DNA, 20 bp, Artificial sequence
  Synthetic oligonucleotide
ttcttcctcactcctatcat

SEQ ID NO: 161 - DNA, 20 bp, Artificial sequence
  Synthetic oligonucleotide
gtatttttcttcctcactcc

SEQ ID NO: 162 - DNA, 20 bp, Artificial sequence
  Synthetic oligonucleotide
ctgaactgctgtgtattttt

SEQ ID NO: 163 - DNA, 20 bp, Artificial sequence
  Synthetic oligonucleotide
atttctctgaactgctgtgt

SEQ ID NO: 164 - DNA, 20 bp, Artificial sequence
  Synthetic oligonucleotide
actggaatttctctgaactg

SEQ ID NO: 165 - DNA, 20 bp, Artificial sequence
  Synthetic oligonucleotide
tttatgctgtgcccctcacg

SEQ ID NO: 166 - DNA, 20 bp, Artificial sequence
  Synthetic oligonucleotide
ctagtgtttatgctgtgccc

SEQ ID NO: 167 - DNA, 20 bp, Artificial sequence
  Synthetic oligonucleotide
ttttccctagtgtttatgct

SEQ ID NO: 168 - DNA, 20 bp, Artificial sequence
  Synthetic oligonucleotide
tatttattttccctagtgtt

SEQ ID NO: 169 - DNA, 20 bp, Artificial sequence
  Synthetic oligonucleotide
ccaggaggaatatatttatt

SEQ ID NO: 170 - DNA, 20 bp, Artificial sequence
  Synthetic oligonucleotide
ctttgtccaggaggaatata

SEQ ID NO: 171 - DNA, 20 bp, Artificial sequence
  Synthetic oligonucleotide
ctatttctttgtccaggagg

SEQ ID NO: 172 - DNA, 20 bp, Artificial sequence
  Synthetic oligonucleotide
acttctctatttctttgtcc

SEQ ID NO: 173 - DNA, 20 bp, Artificial sequence
  Synthetic oligonucleotide
gatatgacttctctatttct

SEQ ID NO: 174 - DNA, 20 bp, Artificial sequence
  Synthetic oligonucleotide
ccccaggatatgacttctct

SEQ ID NO: 175 - DNA, 20 bp, Artificial sequence
  Synthetic oligonucleotide
ccacttccccaggatatgac

SEQ ID NO: 176 - DNA, 20 bp, Artificial sequence
  Synthetic oligonucleotide
tgtctcccacttccccagga

SEQ ID NO: 177 - DNA, 20 bp, Artificial sequence
  Synthetic oligonucleotide
gaattctgtctcccacttcc

SEQ ID NO: 178 - DNA, 20 bp, Artificial sequence
  Synthetic oligonucleotide
cgcggtgaattctgtctccc

SEQ ID NO: 179 - DNA, 20 bp, Artificial sequence
  Synthetic oligonucleotide
acgcggtgaattctgtctcc

SEQ ID NO: 180 - DNA, 20 bp, Artificial sequence
  Synthetic oligonucleotide
atacgcggtgaattctgtct

SEQ ID NO: 181 - DNA, 20 bp, Artificial sequence
  Synthetic oligonucleotide
ccatacgcggtgaattctgt

SEQ ID NO: 182 - DNA, 20 bp, Artificial sequence
  Synthetic oligonucleotide
gcccatacgcggtgaattct

SEQ ID NO: 183 - DNA, 20 bp, Artificial sequence
  Synthetic oligonucleotide
tggcccatacgcggtgaatt

SEQ ID NO: 184 - DNA, 20 bp, Artificial sequence
  Synthetic oligonucleotide
gctggcccatacgcggtgaa

SEQ ID NO: 185 - DNA, 20 bp, Artificial sequence
  Synthetic oligonucleotide
ttaactactctttggtctga

SEQ ID NO: 186 - DNA, 20 bp, Artificial sequence
  Synthetic oligonucleotide
ctggagggcggccgtgtagg

SEQ ID NO: 187 - DNA, 20 bp, Artificial sequence
  Synthetic oligonucleotide
ggagaaccatgagcagaggg

SEQ ID NO: 188 - DNA, 20 bp, Artificial sequence
  Synthetic oligonucleotide
ggagctggagaaccatgagc

SEQ ID NO: 189 - DNA, 20 bp, Artificial sequence
  Synthetic oligonucleotide
gagacaggagctggagaacc

SEQ ID NO: 190 - DNA, 20 bp, Artificial sequence
  Synthetic oligonucleotide
gtgggatacaaattctaggc

SEQ ID NO: 191 - DNA, 20 bp, Artificial sequence
  Synthetic oligonucleotide
ggctggcccatacgcggtga

SEQ ID NO: 192 - DNA, 20 bp, Artificial sequence
  Synthetic oligonucleotide
gatccaggctggcccatacg

SEQ ID NO: 193 - DNA, 20 bp, Artificial sequence
  Synthetic oligonucleotide
gagcccgatccaggctggcc

SEQ ID NO: 194 - DNA, 20 bp, Artificial sequence
  Synthetic oligonucleotide
ggcatggagcccgatccagg

SEQ ID NO: 195 - DNA, 20 bp, Artificial sequence
  Synthetic oligonucleotide
cttgatggcatggagcccga

SEQ ID NO: 196 - DNA, 20 bp, Artificial sequence
  Synthetic oligonucleotide
gtggatcttgatggcatgga

SEQ ID NO: 197 - DNA, 20 bp, Artificial sequence
  Synthetic oligonucleotide
tgagaagtggatcttgatgg

SEQ ID NO: 198 - DNA, 20 bp, Artificial sequence
  Synthetic oligonucleotide
gaagtgtgagaagtggatct

SEQ ID NO: 199 - DNA, 20 bp, Artificial sequence
  Synthetic oligonucleotide
aaatctgaagtgtgagaagt

SEQ ID NO: 200 - DNA, 20 bp, Artificial sequence
  Synthetic oligonucleotide
gggttgaaatctgaagtgtg

SEQ ID NO: 201 - DNA, 20 bp, Artificial sequence
  Synthetic oligonucleotide
gaaccagaattcgggttgaa

SEQ ID NO: 202 - DNA, 20 bp, Artificial sequence
  Synthetic oligonucleotide
tggtctgaaccagaattcgg

SEQ ID NO: 203 - DNA, 20 bp, Artificial sequence
  Synthetic oligonucleotide
actctttggtctgaaccaga

SEQ ID NO: 204 - DNA, 20 bp, Artificial sequence
  Synthetic oligonucleotide
cctccattaactactctttg

SEQ ID NO: 205 - DNA, 20 bp, Artificial sequence
  Synthetic oligonucleotide
ggaacacctccattaactac

SEQ ID NO: 206 - DNA, 20 bp, Artificial sequence
  Synthetic oligonucleotide
ggcgatggccagggaacacc

SEQ ID NO: 207 - DNA, 20 bp, Artificial sequence
  Synthetic oligonucleotide
tgggcaaggcgatggccagg

SEQ ID NO: 208 - DNA, 20 bp, Artificial sequence
  Synthetic oligonucleotide
aggagatgggcaaggcgatg

SEQ ID NO: 209 - DNA, 20 bp, Artificial sequence
  Synthetic oligonucleotide
agaggaaggagatgggcaag

SEQ ID NO: 210 - DNA, 20 bp, Artificial sequence
  Synthetic oligonucleotide
tgggcgagaggaaggagatg

SEQ ID NO: 211 - DNA, 20 bp, Artificial sequence
  Synthetic oligonucleotide
agaaggtgggcgagaggaag

SEQ ID NO: 212 - DNA, 20 bp, Artificial sequence
  Synthetic oligonucleotide
gtagcgagaaggtgggcgag

SEQ ID NO: 213 - DNA, 20 bp, Artificial sequence
  Synthetic oligonucleotide
tgactggtagcgagaaggtg

SEQ ID NO: 214 - DNA, 20 bp, Artificial sequence
  Synthetic oligonucleotide
gggacctgactggtagcgag

SEQ ID NO: 215 - DNA, 20 bp, Artificial sequence
  Synthetic oligonucleotide
agagttgggacctgactggt

SEQ ID NO: 216 - DNA, 20 bp, Artificial sequence
  Synthetic oligonucleotide
tggaagagagttgggacctg

SEQ ID NO: 217 - DNA, 20 bp, Artificial sequence
  Synthetic oligonucleotide
ccgaggtggaagagagttgg

SEQ ID NO: 218 - DNA, 20 bp, Artificial sequence
  Synthetic oligonucleotide
ggctgcccgaggtggaagag

SEQ ID NO: 219 - DNA, 20 bp, Artificial sequence
  Synthetic oligonucleotide
ggtctggatggccgcgaggg

SEQ ID NO: 220 - DNA, 20 bp, Artificial sequence
  Synthetic oligonucleotide
tggagaaccatgagcagagg

SEQ ID NO: 221 - DNA, 20 bp, Artificial sequence
  Synthetic oligonucleotide
gctggagaaccatgagcaga

SEQ ID NO: 222 - DNA, 20 bp, Artificial sequence
  Synthetic oligonucleotide
gagctggagaaccatgagca

SEQ ID NO: 223 - DNA, 20 bp, Artificial sequence
  Synthetic oligonucleotide
aggagctggagaaccatgag

SEQ ID NO: 224 - DNA, 20 bp, Artificial sequence
  Synthetic oligonucleotide
acaggagctggagaaccatg

SEQ ID NO: 225 - DNA, 20 bp, Artificial sequence
  Synthetic oligonucleotide
agacaggagctggagaacca

SEQ ID NO: 226 - DNA, 20 bp, Artificial sequence
  Synthetic oligonucleotide
atagtagagacaggagctgg

SEQ ID NO: 227 - DNA, 20 bp, Artificial sequence
  Synthetic oligonucleotide
ttaggcatagtagagacagg

SEQ ID NO: 228 - DNA, 20 bp, Artificial sequence
  Synthetic oligonucleotide
ggcccttctgaagacatgcg

SEQ ID NO: 229 - DNA, 20 bp, Artificial sequence
  Synthetic oligonucleotide
cttggaggcccttctgaaga

SEQ ID NO: 230 - DNA, 20 bp, Artificial sequence
  Synthetic oligonucleotide
gacatccttggaggcccttc

SEQ ID NO: 231 - DNA, 20 bp, Artificial sequence
  Synthetic oligonucleotide
ggatgtcgctgggcctttgg

SEQ ID NO: 232 - DNA, 20 bp, Artificial sequence
  Synthetic oligonucleotide
tttcgaggatgtcgctgggc

SEQ ID NO: 233 - DNA, 20 bp, Artificial sequence
  Synthetic oligonucleotide
ctgtgatttcgaggatgtcg

SEQ ID NO: 234 - DNA, 20 bp, Artificial sequence
  Synthetic oligonucleotide
gaaactctgtgatttcgagg

SEQ ID NO: 235 - DNA, 20 bp, Artificial sequence
  Synthetic oligonucleotide
ccagcagaaactctgtgatt

SEQ ID NO: 236 - DNA, 20 bp, Artificial sequence
  Synthetic oligonucleotide
cccctcccagcagaaactct

SEQ ID NO: 237 - DNA, 20 bp, Artificial sequence
  Synthetic oligonucleotide
atggaacccctcccagcaga

SEQ ID NO: 238 - DNA, 20 bp, Artificial sequence
  Synthetic oligonucleotide
ctggatatggaacccctccc

SEQ ID NO: 239 - DNA, 20 bp, Artificial sequence
  Synthetic oligonucleotide
aggccactggatatggaacc

SEQ ID NO: 240 - DNA, 20 bp, Artificial sequence
  Synthetic oligonucleotide
aattctaggccactggatat

SEQ ID NO: 241 - DNA, 20 bp, Artificial sequence
  Synthetic oligonucleotide
atacaaattctaggccactg

SEQ ID NO: 242 - DNA, 20 bp, Artificial sequence
  Synthetic oligonucleotide
ggatacaaattctaggccac

SEQ ID NO: 243 - DNA, 20 bp, Artificial sequence
  Synthetic oligonucleotide
tgggatacaaattctaggcc

SEQ ID NO: 244 - DNA, 20 bp, Artificial sequence
  Synthetic oligonucleotide
tgtgggatacaaattctagg

SEQ ID NO: 245 - DNA, 20 bp, Artificial sequence
  Synthetic oligonucleotide
gttgtgggatacaaattcta

SEQ ID NO: 246 - DNA, 20 bp, Artificial sequence
  Synthetic oligonucleotide
gtagctgcttcactgggtgg

SEQ ID NO: 247 - DNA, 20 bp, Artificial sequence
  Synthetic oligonucleotide
ggaggagtagctgcttcact

SEQ ID NO: 248 - DNA, 20 bp, Artificial sequence
  Synthetic oligonucleotide
gctactggaggagtagctgc

SEQ ID NO: 249 - DNA, 20 bp, Artificial sequence
  Synthetic oligonucleotide
gtccttgctactggaggagt

SEQ ID NO: 250 - DNA, 20 bp, Artificial sequence
  Synthetic oligonucleotide
ggactggtccttgctactgg

SEQ ID NO: 251 - DNA, 20 bp, Artificial sequence
  Synthetic oligonucleotide
cccgagggactggtccttgc

SEQ ID NO: 252 - DNA, 20 bp, Artificial sequence
  Synthetic oligonucleotide
gttccccccgagggactggt

SEQ ID NO: 253 - DNA, 20 bp, Artificial sequence
  Synthetic oligonucleotide
actgaccactgatgaccacg

SEQ ID NO: 254 - DNA, 20 bp, Artificial sequence
  Synthetic oligonucleotide
aaccccactgaccactgatg

SEQ ID NO: 255 - DNA, 20 bp, Artificial sequence
  Synthetic oligonucleotide
tcttggaaccccactgacca

SEQ ID NO: 256 - DNA, 20 bp, Artificial sequence
  Synthetic oligonucleotide
ggataatcttggaaccccac

SEQ ID NO: 257 - DNA, 20 bp, Artificial sequence
  Synthetic oligonucleotide
ctgggtctatgagttttagg

SEQ ID NO: 258 - DNA, 20 bp, Artificial sequence
  Synthetic oligonucleotide
ggagacctgggtctatgagt

SEQ ID NO: 259 - DNA, 20 bp, Artificial sequence
  Synthetic oligonucleotide
gttctgtctgggagacctgg

SEQ ID NO: 260 - DNA, 20 bp, Artificial sequence
  Synthetic oligonucleotide
aatactgttctgtctgggag

SEQ ID NO: 261 - DNA, 20 bp, Artificial sequence
  Synthetic oligonucleotide
atttccaatactgttctgtc

SEQ ID NO: 262 - DNA, 20 bp, Artificial sequence
  Synthetic oligonucleotide
gcaagaactggcccactggg

SEQ ID NO: 263 - DNA, 20 bp, Artificial sequence
  Synthetic oligonucleotide
ggagaagcaagaactggccc

SEQ ID NO: 264 - DNA, 20 bp, Artificial sequence
  Synthetic oligonucleotide
tggaataataccagcttggg

SEQ ID NO: 265 - DNA, 20 bp, Artificial sequence
  Synthetic oligonucleotide
ttcagttggaataataccag

SEQ ID NO: 266 - DNA, 20 bp, Artificial sequence
  Synthetic oligonucleotide
aacagcttcagttggaataa

SEQ ID NO: 267 - DNA, 20 bp, Artificial sequence
  Synthetic oligonucleotide
catggcaacagcttcagttg

SEQ ID NO: 268 - DNA, 20 bp, Artificial sequence
  Synthetic oligonucleotide
aataggcatggcaacagctt

SEQ ID NO: 269 - DNA, 20 bp, Artificial sequence
  Synthetic oligonucleotide
agctggaataggcatggcaa

SEQ ID NO: 270 - DNA, 20 bp, Artificial sequence
  Synthetic oligonucleotide
agatgcagctggaataggca

SEQ ID NO: 271 - DNA, 20 bp, Artificial sequence
  Synthetic oligonucleotide
cgtaggagatgcagctggaa

SEQ ID NO: 272 - DNA, 20 bp, Artificial sequence
  Synthetic oligonucleotide
cgatgcaggactagcaggcg

SEQ ID NO: 273 - DNA, 20 bp, Artificial sequence
  Synthetic oligonucleotide
tctgttcgatgcaggactag

SEQ ID NO: 274 - DNA, 20 bp, Artificial sequence
  Synthetic oligonucleotide
aacagctctgttcgatgcag

SEQ ID NO: 275 - DNA, 20 bp, Artificial sequence
  Synthetic oligonucleotide
tggaatctttagcctcacta

SEQ ID NO: 276 - DNA, 20 bp, Artificial sequence
  Synthetic oligonucleotide
gaagcctggaatctttagcc

SEQ ID NO: 277 - DNA, 20 bp, Artificial sequence
  Synthetic oligonucleotide
gatcttgaagcctggaatct

SEQ ID NO: 278 - DNA, 20 bp, Artificial sequence
  Synthetic oligonucleotide
gcctctgatcttgaagcctg

SEQ ID NO: 279 - DNA, 20 bp, Artificial sequence
  Synthetic oligonucleotide
agttctgcctctgatcttga

SEQ ID NO: 280 - DNA, 20 bp, Artificial sequence
  Synthetic oligonucleotide
caggagagttctgcctctga

SEQ ID NO: 281 - DNA, 20 bp, Artificial sequence
  Synthetic oligonucleotide
tccctgcaggagagttctgc

SEQ ID NO: 282 - DNA, 20 bp, Artificial sequence
  Synthetic oligonucleotide
ctttattccctgcaggagag

SEQ ID NO: 283 - DNA, 20 bp, Artificial sequence
  Synthetic oligonucleotide
tattttctttattccctgca

SEQ ID NO: 284 - DNA, 20 bp, Artificial sequence
  Synthetic oligonucleotide
gtttaatattttctttattc

SEQ ID NO: 285 - DNA, 20 bp, Artificial sequence
  Synthetic oligonucleotide
cattgggtttaatattttct

SEQ ID NO: 286 - DNA, 20 bp, Artificial sequence
  Synthetic oligonucleotide
atgtttcattgggtttaata

SEQ ID NO: 287 - DNA, 20 bp, Artificial sequence
  Synthetic oligonucleotide
taggtgatgtttcattgggt

SEQ ID NO: 288 - DNA, 20 bp, Artificial sequence
  Synthetic oligonucleotide
agaagctaggtgatgtttca

SEQ ID NO: 289 - DNA, 20 bp, Artificial sequence
  Synthetic oligonucleotide
cttttgagaagctaggtgat

SEQ ID NO: 290 - DNA, 20 bp, Artificial sequence
  Synthetic oligonucleotide
tttcagcttttgagaagcta

SEQ ID NO: 291 - DNA, 20 bp, Artificial sequence
  Synthetic oligonucleotide
ctttgttttcagcttttgag

SEQ ID NO: 292 - DNA, 20 bp, Artificial sequence
  Synthetic oligonucleotide
atatacctttgttttcagct

SEQ ID NO: 293 - DNA, 20 bp, Artificial sequence
  Synthetic oligonucleotide
ctggtgatatacctttgttt

SEQ ID NO: 294 - DNA, 20 bp, Artificial sequence
  Synthetic oligonucleotide
aaacaactggtgatatacct

SEQ ID NO: 295 - DNA, 20 bp, Artificial sequence
  Synthetic oligonucleotide
gttcagaaacaactggtgat

SEQ ID NO: 296 - DNA, 20 bp, Artificial sequence
  Synthetic oligonucleotide
ttctatgttcagaaacaact

SEQ ID NO: 297 - DNA, 20 bp, Artificial sequence
  Synthetic oligonucleotide
tctgttttctatgttcagaa

SEQ ID NO: 298 - DNA, 20 bp, Artificial sequence
  Synthetic oligonucleotide
catcaatctgttttctatgt

SEQ ID NO: 299 - DNA, 20 bp, Artificial sequence
  Synthetic oligonucleotide
ttaaatcatcaatctgtttt

SEQ ID NO: 300 - DNA, 20 bp, Artificial sequence
  Synthetic oligonucleotide
atttctttaaatcatcaatc

SEQ ID NO: 301 - DNA, 20 bp, Artificial sequence
  Synthetic oligonucleotide
tcttaaatttctttaaatca

SEQ ID NO: 302 - DNA, 20 bp, Artificial sequence
  Synthetic oligonucleotide
aatcattcttaaatttcttt

SEQ ID NO: 303 - DNA, 20 bp, Artificial sequence
  Synthetic oligonucleotide
acctaaaatcattcttaaat

SEQ ID NO: 304 - DNA, 20 bp, Artificial sequence
  Synthetic oligonucleotide
gctgtaacctaaaatcattc

SEQ ID NO: 305 - DNA, 20 bp, Artificial sequence
  Synthetic oligonucleotide
aacttggctgtaacctaaaa

SEQ ID NO: 306 - DNA, 20 bp, Artificial sequence
  Synthetic oligonucleotide
aagtagaacttggctgtaac

SEQ ID NO: 307 - DNA, 20 bp, Artificial sequence
  Synthetic oligonucleotide
attcagaagtagaacttggc

SEQ ID NO: 308 - DNA, 20 bp, Artificial sequence
  Synthetic oligonucleotide
ccatagattcagaagtagaa

SEQ ID NO: 309 - DNA, 20 bp, Artificial sequence
  Synthetic oligonucleotide
gttgatccatagattcagaa

SEQ ID NO: 310 - DNA, 20 bp, Artificial sequence
  Synthetic oligonucleotide
ttagtagttgatccatagat

SEQ ID NO: 311 - DNA, 20 bp, Artificial sequence
  Synthetic oligonucleotide
ttttgtttagtagttgatcc

SEQ ID NO: 312 - DNA, 20 bp, Artificial sequence
  Synthetic oligonucleotide
ctctatttttgtttagtagt

SEQ ID NO: 313 - DNA, 20 bp, Artificial sequence
  Synthetic oligonucleotide
ctccctctctatttttgttt

SEQ ID NO: 314 - DNA, 20 bp, Artificial sequence
  Synthetic oligonucleotide
atttttctccctctctattt

SEQ ID NO: 315 - DNA, 20 bp, Artificial sequence
  Synthetic oligonucleotide
ctcttgatttttctccctct

SEQ ID NO: 316 - DNA, 20 bp, Artificial sequence
  Synthetic oligonucleotide
tcaaatctcttgatttttct

SEQ ID NO: 317 - DNA, 20 bp, Artificial sequence
  Synthetic oligonucleotide
ctttgatcaaatctcttgat

SEQ ID NO: 318 - DNA, 20 bp, Artificial sequence
  Synthetic oligonucleotide
ttttgtctttgatcaaatct

SEQ ID NO: 319 - DNA, 20 bp, Artificial sequence
  Synthetic oligonucleotide
gttcaattttgtctttgatc

SEQ ID NO: 320 - DNA, 20 bp, Artificial sequence
  Synthetic oligonucleotide
cacttggttcaattttgtct

SEQ ID NO: 321 - DNA, 20 bp, Artificial sequence
  Synthetic oligonucleotide
ccttagcacttggttcaatt

SEQ ID NO: 322 - DNA, 20 bp, Artificial sequence
  Synthetic oligonucleotide
aagaatccttagcacttggt

SEQ ID NO: 323 - DNA, 20 bp, Artificial sequence
  Synthetic oligonucleotide
caatgaaagaatccttagca

SEQ ID NO: 324 - DNA, 20 bp, Artificial sequence
  Synthetic oligonucleotide
tattttcaatgaaagaatcc

SEQ ID NO: 325 - DNA, 20 bp, Artificial sequence
  Synthetic oligonucleotide
tgctgctattttcaatgaaa

SEQ ID NO: 326 - DNA, 20 bp, Artificial sequence
  Synthetic oligonucleotide
agttgctgctgctattttca

SEQ ID NO: 327 - DNA, 20 bp, Artificial sequence
  Synthetic oligonucleotide
acagttgctgctgctatttt

SEQ ID NO: 328 - DNA, 20 bp, Artificial sequence
  Synthetic oligonucleotide
gtacagttgctgctgctatt

SEQ ID NO: 329 - DNA, 20 bp, Artificial sequence
  Synthetic oligonucleotide
tggtacagttgctgctgcta

SEQ ID NO: 330 - DNA, 20 bp, Artificial sequence
  Synthetic oligonucleotide
ctggtacagttgctgctgct

SEQ ID NO: 331 - DNA, 20 bp, Artificial sequence
  Synthetic oligonucleotide
actggtacagttgctgctgc

SEQ ID NO: 332 - DNA, 20 bp, Artificial sequence
  Synthetic oligonucleotide
ccactggtacagttgctgct

SEQ ID NO: 333 - DNA, 20 bp, Artificial sequence
  Synthetic oligonucleotide
tgccactggtacagttgctg

SEQ ID NO: 334 - DNA, 20 bp, Artificial sequence
  Synthetic oligonucleotide
tgctgctgccactggtacag

SEQ ID NO: 335 - DNA, 20 bp, Artificial sequence
  Synthetic oligonucleotide
tcggcttgctgctgccactg

SEQ ID NO: 336 - DNA, 20 bp, Artificial sequence
  Synthetic oligonucleotide
ggctattcggcttgctgctg

SEQ ID NO: 337 - DNA, 20 bp, Artificial sequence
  Synthetic oligonucleotide
tgttactaagtattgaaggg

SEQ ID NO: 338 - DNA, 20 bp, Artificial sequence
  Synthetic oligonucleotide
gctccgtgttactaagtatt

SEQ ID NO: 339 - DNA, 20 bp, Artificial sequence
  Synthetic oligonucleotide
tcttgtgctccgtgttacta

SEQ ID NO: 340 - DNA, 20 bp, Artificial sequence
  Synthetic oligonucleotide
gtcccctcttgtgctccgtg

SEQ ID NO: 341 - DNA, 20 bp, Artificial sequence
  Synthetic oligonucleotide
cctcaggtcccctcttgtgc

SEQ ID NO: 342 - DNA, 20 bp, Artificial sequence
  Synthetic oligonucleotide
aagtgacctcaggtcccctc

SEQ ID NO: 343 - DNA, 20 bp, Artificial sequence
  Synthetic oligonucleotide
cttgggaagtgacctcaggt

SEQ ID NO: 344 - DNA, 20 bp, Artificial sequence
  Synthetic oligonucleotide
gaaccccttgggaagtgacc

SEQ ID NO: 345 - DNA, 20 bp, Artificial sequence
  Synthetic oligonucleotide
aagtctgaaccccttgggaa

SEQ ID NO: 346 - DNA, 20 bp, Artificial sequence
  Synthetic oligonucleotide
ggctggaagtctgaacccct

SEQ ID NO: 347 - DNA, 20 bp, Artificial sequence
  Synthetic oligonucleotide
atgctgggctggaagtctga

SEQ ID NO: 348 - DNA, 20 bp, Artificial sequence
  Synthetic oligonucleotide
gtttacatgctgggctggaa

SEQ ID NO: 349 - DNA, 20 bp, Artificial sequence
  Synthetic oligonucleotide
tctcttgtttacatgctggg

SEQ ID NO: 350 - DNA, 20 bp, Artificial sequence
  Synthetic oligonucleotide
cgtctttctcttgtttacat

SEQ ID NO: 351 - DNA, 20 bp, Artificial sequence
  Synthetic oligonucleotide
ctttcttctcttccttatcg

SEQ ID NO: 352 - DNA, 20 bp, Artificial sequence
  Synthetic oligonucleotide
tcctaacttgctcagctgcg

SEQ ID NO: 353 - DNA, 20 bp, Artificial sequence
  Synthetic oligonucleotide
tgttgatttcctaacttgct

SEQ ID NO: 354 - DNA, 20 bp, Artificial sequence
  Synthetic oligonucleotide
attcaatgttgatttcctaa

SEQ ID NO: 355 - DNA, 20 bp, Artificial sequence
  Synthetic oligonucleotide
tgcattgggattcaatgttg

SEQ ID NO: 356 - DNA, 20 bp, Artificial sequence
  Synthetic oligonucleotide
gtgggttgaactcctttgca

SEQ ID NO: 357 - DNA, 20 bp, Artificial sequence
  Synthetic oligonucleotide
tttggctgagagaaggaacg

SEQ ID NO: 358 - DNA, 20 bp, Artificial sequence
  Synthetic oligonucleotide
gaaggctttggctgagagaa

SEQ ID NO: 359 - DNA, 20 bp, Artificial sequence
  Synthetic oligonucleotide
gtagtagaaggctttggctg

SEQ ID NO: 360 - DNA, 20 bp, Artificial sequence
  Synthetic oligonucleotide
gaggccgaggtgaagttggg

SEQ ID NO: 361 - DNA, 20 bp, Artificial sequence
  Synthetic oligonucleotide
gtgcttgaggccgaggtgaa

SEQ ID NO: 362 - DNA, 20 bp, Artificial sequence
  Synthetic oligonucleotide
taggttgtgcttgaggccga

SEQ ID NO: 363 - DNA, 20 bp, Artificial sequence
  Synthetic oligonucleotide
atgggctaggttgtgcttga

SEQ ID NO: 364 - DNA, 20 bp, Artificial sequence
  Synthetic oligonucleotide
ccatagatgggctaggttgt

SEQ ID NO: 365 - DNA, 20 bp, Artificial sequence
  Synthetic oligonucleotide
gacccaccatagatgggcta

SEQ ID NO: 366 - DNA, 20 bp, Artificial sequence
  Synthetic oligonucleotide
gttgatgacccaccatagat

SEQ ID NO: 367 - DNA, 20 bp, Artificial sequence
  Synthetic oligonucleotide
ttggctgttgatgacccacc

SEQ ID NO: 368 - DNA, 20 bp, Artificial sequence
  Synthetic oligonucleotide
ctggagttggctgttgatga

SEQ ID NO: 369 - DNA, 20 bp, Artificial sequence
  Synthetic oligonucleotide
tataaactggagttggctgt

SEQ ID NO: 370 - DNA, 20 bp, Artificial sequence
  Synthetic oligonucleotide
gctgagtataaactggagtt

SEQ ID NO: 371 - DNA, 20 bp, Artificial sequence
  Synthetic oligonucleotide
aaacaggctgagtataaact

SEQ ID NO: 372 - DNA, 20 bp, Artificial sequence
  Synthetic oligonucleotide
caaaacaaacaggctgagta

SEQ ID NO: 373 - DNA, 20 bp, Artificial sequence
  Synthetic oligonucleotide
ttggtgcaaaacaaacaggc

SEQ ID NO: 374 - DNA, 20 bp, Artificial sequence
  Synthetic oligonucleotide
tcatatttggtgcaaaacaa

SEQ ID NO: 375 - DNA, 20 bp, Artificial sequence
  Synthetic oligonucleotide
gatacatcatatttggtgca

SEQ ID NO: 376 - DNA, 20 bp, Artificial sequence
  Synthetic oligonucleotide
ggactggatacatcatattt

SEQ ID NO: 377 - DNA, 20 bp, Artificial sequence
  Synthetic oligonucleotide
tcactgggactggatacatc

SEQ ID NO: 378 - DNA, 20 bp, Artificial sequence
  Synthetic oligonucleotide
tgcacgcctgggctcactgg

SEQ ID NO: 379 - DNA, 20 bp, Artificial sequence
  Synthetic oligonucleotide
aaaggttgcacgcctgggct

SEQ ID NO: 380 - DNA, 20 bp, Artificial sequence
  Synthetic oligonucleotide
gggtataaaggttgcacgcc

SEQ ID NO: 381 - DNA, 20 bp, Artificial sequence
  Synthetic oligonucleotide
ggtattgggtataaaggttg

SEQ ID NO: 382 - DNA, 20 bp, Artificial sequence
  Synthetic oligonucleotide
gtcataggtattgggtataa

SEQ ID NO: 383 - DNA, 20 bp, Artificial sequence
  Synthetic oligonucleotide
ttgattcactggcatgggcg

SEQ ID NO: 384 - DNA, 20 bp, Artificial sequence
  Synthetic oligonucleotide
cttggcttgattcactggca

SEQ ID NO: 385 - DNA, 20 bp, Artificial sequence
  Synthetic oligonucleotide
atatgtcttggcttgattca

SEQ ID NO: 386 - DNA, 20 bp, Artificial sequence
  Synthetic oligonucleotide
tgctctatatgtcttggctt

SEQ ID NO: 387 - DNA, 20 bp, Artificial sequence
  Synthetic oligonucleotide
tggtactgctctatatgtct

SEQ ID NO: 388 - DNA, 20 bp, Artificial sequence
  Synthetic oligonucleotide
catatttggtactgctctat

SEQ ID NO: 389 - DNA, 20 bp, Artificial sequence
  Synthetic oligonucleotide
ctggtcttgccgctgttggg

SEQ ID NO: 390 - DNA, 20 bp, Artificial sequence
  Synthetic oligonucleotide
atgatgctggtcttgccgct

SEQ ID NO: 391 - DNA, 20 bp, Artificial sequence
  Synthetic oligonucleotide
actctgatgatgctggtctt

SEQ ID NO: 392 - DNA, 20 bp, Artificial sequence
  Synthetic oligonucleotide
catggcactctgatgatgct

SEQ ID NO: 393 - DNA, 20 bp, Artificial sequence
  Synthetic oligonucleotide
gtgcatcatggcactctgat

SEQ ID NO: 394 - DNA, 20 bp, Artificial sequence
  Synthetic oligonucleotide
cgctgggtgcatcatggcac

SEQ ID NO: 395 - DNA, 20 bp, Artificial sequence
  Synthetic oligonucleotide
ggtgggcccgctgctgacgc

SEQ ID NO: 396 - DNA, 20 bp, Artificial sequence
  Synthetic oligonucleotide
gcaatcggtgggcccgctgc

SEQ ID NO: 397 - DNA, 20 bp, Artificial sequence
  Synthetic oligonucleotide
gtggctgcaatcggtgggcc

SEQ ID NO: 398 - DNA, 20 bp, Artificial sequence
  Synthetic oligonucleotide
actgtaggcaacatattgcg

SEQ ID NO: 399 - DNA, 20 bp, Artificial sequence
  Synthetic oligonucleotide
ctgaggactgtaggcaacat

SEQ ID NO: 400 - DNA, 20 bp, Artificial sequence
  Synthetic oligonucleotide
tggcacatgctgaacaaggg

SEQ ID NO: 401 - DNA, 20 bp, Artificial sequence
  Synthetic oligonucleotide
ataatgtggcacatgctgaa

SEQ ID NO: 402 - DNA, 20 bp, Artificial sequence
  Synthetic oligonucleotide
agactgataatgtggcacat

SEQ ID NO: 403 - DNA, 20 bp, Artificial sequence
  Synthetic oligonucleotide
atgctgagactgataatgtg

SEQ ID NO: 404 - DNA, 20 bp, Artificial sequence
  Synthetic oligonucleotide
atgaggatgctgagactgat

SEQ ID NO: 405 - DNA, 20 bp, Artificial sequence
  Synthetic oligonucleotide
atagacatgaggatgctgag

SEQ ID NO: 406 - DNA, 20 bp, Artificial sequence
  Synthetic oligonucleotide
aggactatagacatgaggat

SEQ ID NO: 407 - DNA, 20 bp, Artificial sequence
  Synthetic oligonucleotide
tattacaggactatagacat

SEQ ID NO: 408 - DNA, 20 bp, Artificial sequence
  Synthetic oligonucleotide
accctgtattacaggactat

SEQ ID NO: 409 - DNA, 20 bp, Artificial sequence
  Synthetic oligonucleotide
agcattaccctgtattacag

SEQ ID NO: 410 - DNA, 20 bp, Artificial sequence
  Synthetic oligonucleotide
cattctagcattaccctgta

SEQ ID NO: 411 - DNA, 20 bp, Artificial sequence
  Synthetic oligonucleotide
tgccatcattctagcattac

SEQ ID NO: 412 - DNA, 20 bp, Artificial sequence
  Synthetic oligonucleotide
tggtggtgccatcattctag

SEQ ID NO: 413 - DNA, 20 bp, Artificial sequence
  Synthetic oligonucleotide
atactaaaccaggctgggcg

SEQ ID NO: 414 - DNA, 20 bp, Artificial sequence
  Synthetic oligonucleotide
aagaagatactaaaccaggc

SEQ ID NO: 415 - DNA, 20 bp, Artificial sequence
  Synthetic oligonucleotide
ttgctgaagaagatactaaa

SEQ ID NO: 416 - DNA, 20 bp, Artificial sequence
  Synthetic oligonucleotide
tggtaatttgggacatgcat

SEQ ID NO: 417 - DNA, 20 bp, Artificial sequence
  Synthetic oligonucleotide
gcttgtctccttgttgtatg

SEQ ID NO: 418 - DNA, 20 bp, Artificial sequence
  Synthetic oligonucleotide
gtacatgagcctgaggtacg

SEQ ID NO: 419 - DNA, 20 bp, Artificial sequence
  Synthetic oligonucleotide
tcattagcatcattggcgca

SEQ ID NO: 420 - DNA, 20 bp, Artificial sequence
  Synthetic oligonucleotide
actgagttgctgaagaagat

SEQ ID NO: 421 - DNA, 20 bp, Artificial sequence
  Synthetic oligonucleotide
ccccgtactgagttgctgaa

SEQ ID NO: 422 - DNA, 20 bp, Artificial sequence
  Synthetic oligonucleotide
catgagccccgtactgagtt

SEQ ID NO: 423 - DNA, 20 bp, Artificial sequence
  Synthetic oligonucleotide
tctgctcatgagccccgtac

SEQ ID NO: 424 - DNA, 20 bp, Artificial sequence
  Synthetic oligonucleotide
acatgcatacatcgcatgcg

SEQ ID NO: 425 - DNA, 20 bp, Artificial sequence
  Synthetic oligonucleotide
tttgggacatgcatacatcg

SEQ ID NO: 426 - DNA, 20 bp, Artificial sequence
  Synthetic oligonucleotide
gttgtatggtaatttgggac

SEQ ID NO: 427 - DNA, 20 bp, Artificial sequence
  Synthetic oligonucleotide
ctccttgttgtatggtaatt

SEQ ID NO: 428 - DNA, 20 bp, Artificial sequence
  Synthetic oligonucleotide
agaagggcttgtctccttgt

SEQ ID NO: 429 - DNA, 20 bp, Artificial sequence
  Synthetic oligonucleotide
gtagaaagaagggcttgtct

SEQ ID NO: 430 - DNA, 20 bp, Artificial sequence
  Synthetic oligonucleotide
ggcaaagtagaaagaagggc

SEQ ID NO: 431 - DNA, 20 bp, Artificial sequence
  Synthetic oligonucleotide
ggaaatggcaaagtagaaag

SEQ ID NO: 432 - DNA, 20 bp, Artificial sequence
  Synthetic oligonucleotide
gcccgtggaaatggcaaagt

SEQ ID NO: 433 - DNA, 20 bp, Artificial sequence
  Synthetic oligonucleotide
aagggagcccgtggaaatgg

SEQ ID NO: 434 - DNA, 20 bp, Artificial sequence
  Synthetic oligonucleotide
ctgagcaagggagcccgtgg

SEQ ID NO: 435 - DNA, 20 bp, Artificial sequence
  Synthetic oligonucleotide
atactgctgagcaagggagc

SEQ ID NO: 436 - DNA, 20 bp, Artificial sequence
  Synthetic oligonucleotide
gtgcgcatactgctgagcaa

SEQ ID NO: 437 - DNA, 20 bp, Artificial sequence
  Synthetic oligonucleotide
gttagggtgcgcatactgct

SEQ ID NO: 438 - DNA, 20 bp, Artificial sequence
  Synthetic oligonucleotide
gtggagtatgtgggtgcagg

SEQ ID NO: 439 - DNA, 20 bp, Artificial sequence
  Synthetic oligonucleotide
tgagggtgtggagtatgtgg

SEQ ID NO: 440 - DNA, 20 bp, Artificial sequence
  Synthetic oligonucleotide
gaaggctgagggtgtggagt

SEQ ID NO: 441 - DNA, 20 bp, Artificial sequence
  Synthetic oligonucleotide
gtagctgaaggctgagggtg

SEQ ID NO: 442 - DNA, 20 bp, Artificial sequence
  Synthetic oligonucleotide
ctttgctgctgtccagtggg

SEQ ID NO: 443 - DNA, 20 bp, Artificial sequence
  Synthetic oligonucleotide
tgttggctttgctgctgtcc

SEQ ID NO: 444 - DNA, 20 bp, Artificial sequence
  Synthetic oligonucleotide
ccaccatgttggctttgctg

SEQ ID NO: 445 - DNA, 20 bp, Artificial sequence
  Synthetic oligonucleotide
tgacttccaccatgttggct

SEQ ID NO: 446 - DNA, 20 bp, Artificial sequence
  Synthetic oligonucleotide
gcaggatgacttccaccatg

SEQ ID NO: 447 - DNA, 20 bp, Artificial sequence
  Synthetic oligonucleotide
ctgggtgcaggatgacttcc

SEQ ID NO: 448 - DNA, 20 bp, Artificial sequence
  Synthetic oligonucleotide
aacaggactgggtgcaggat

SEQ ID NO: 449 - DNA, 20 bp, Artificial sequence
  Synthetic oligonucleotide
gatggtgctgaacaggactg

SEQ ID NO: 450 - DNA, 20 bp, Artificial sequence
  Synthetic oligonucleotide
ggtgctgatggtgctgaaca

SEQ ID NO: 451 - DNA, 20 bp, Artificial sequence
  Synthetic oligonucleotide
cggcctggtgctgatggtgc

SEQ ID NO: 452 - DNA, 20 bp, Artificial sequence
  Synthetic oligonucleotide
cctgggcggcctggtgctga

SEQ ID NO: 453 - DNA, 20 bp, Artificial sequence
  Synthetic oligonucleotide
ggagagcctgggcggcctgg

SEQ ID NO: 454 - DNA, 20 bp, Artificial sequence
  Synthetic oligonucleotide
ccagatggagagcctgggcg

SEQ ID NO: 455 - DNA, 20 bp, Artificial sequence
  Synthetic oligonucleotide
gactggccagatggagagcc

SEQ ID NO: 456 - DNA, 20 bp, Artificial sequence
  Synthetic oligonucleotide
gctgtggactggccagatgg

SEQ ID NO: 457 - DNA, 20 bp, Artificial sequence
  Synthetic oligonucleotide
actgctgctgtggactggcc

SEQ ID NO: 458 - DNA, 20 bp, Artificial sequence
  Synthetic oligonucleotide
tggctgactgctgctgtgga

SEQ ID NO: 459 - DNA, 20 bp, Artificial sequence
  Synthetic oligonucleotide
ggtaaatggctgactgctgc

SEQ ID NO: 460 - DNA, 20 bp, Artificial sequence
  Synthetic oligonucleotide
gagttggcgcaagccccgcg

SEQ ID NO: 461 - DNA, 20 bp, Artificial sequence
  Synthetic oligonucleotide
agggtggagttggcgcaagc

SEQ ID NO: 462 - DNA, 20 bp, Artificial sequence
  Synthetic oligonucleotide
tcatggagggtggagttggc

SEQ ID NO: 463 - DNA, 20 bp, Artificial sequence
  Synthetic oligonucleotide
caggtgtcatggagggtgga

SEQ ID NO: 464 - DNA, 20 bp, Artificial sequence
  Synthetic oligonucleotide
tggaggcaggtgtcatggag

SEQ ID NO: 465 - DNA, 20 bp, Artificial sequence
  Synthetic oligonucleotide
actattctgtggcgactgcg

SEQ ID NO: 466 - DNA, 20 bp, Artificial sequence
  Synthetic oligonucleotide
tgggaaactattctgtggcg

SEQ ID NO: 467 - DNA, 20 bp, Artificial sequence
  Synthetic oligonucleotide
tgctgctgggaaactattct

SEQ ID NO: 468 - DNA, 20 bp, Artificial sequence
  Synthetic oligonucleotide
ctgttgtgctgctgggaaac

SEQ ID NO: 469 - DNA, 20 bp, Artificial sequence
  Synthetic oligonucleotide
gacagtctgttgtgctgctg

SEQ ID NO: 470 - DNA, 20 bp, Artificial sequence
  Synthetic oligonucleotide
cgtaaagacagtctgttgtg

SEQ ID NO: 471 - DNA, 20 bp, Artificial sequence
  Synthetic oligonucleotide
tggtatacgccggctgaacg

SEQ ID NO: 472 - DNA, 20 bp, Artificial sequence
  Synthetic oligonucleotide
gtgggttggtatacgccggc

SEQ ID NO: 473 - DNA, 20 bp, Artificial sequence
  Synthetic oligonucleotide
ctgactgtacatgagcctga

SEQ ID NO: 474 - DNA, 20 bp, Artificial sequence
  Synthetic oligonucleotide
ccattcctgactgtacatga

SEQ ID NO: 475 - DNA, 20 bp, Artificial sequence
  Synthetic oligonucleotide
aaggaaccattcctgactgt

SEQ ID NO: 476 - DNA, 20 bp, Artificial sequence
  Synthetic oligonucleotide
gatgagaaggaaccattcct

SEQ ID NO: 477 - DNA, 20 bp, Artificial sequence
  Synthetic oligonucleotide
cagttggatgagaaggaacc

SEQ ID NO: 478 - DNA, 20 bp, Artificial sequence
  Synthetic oligonucleotide
catgggcagttggatgagaa

SEQ ID NO: 479 - DNA, 20 bp, Artificial sequence
  Synthetic oligonucleotide
ttggcgcatgggcagttgga

SEQ ID NO: 480 - DNA, 20 bp, Artificial sequence
  Synthetic oligonucleotide
gcatcattggcgcatgggca

SEQ ID NO: 481 - DNA, 20 bp, Artificial sequence
  Synthetic oligonucleotide
accgccgggtggctgtgtcg

SEQ ID NO: 482 - DNA, 20 bp, Artificial sequence
  Synthetic oligonucleotide
tttgagcgagggcggcctgg

SEQ ID NO: 483 - DNA, 20 bp, Artificial sequence
  Synthetic oligonucleotide
gtgcactttgagcgagggcg

SEQ ID NO: 484 - DNA, 20 bp, Artificial sequence
  Synthetic oligonucleotide
gaatgggctgtagtgcactt

SEQ ID NO: 485 - DNA, 20 bp, Artificial sequence
  Synthetic oligonucleotide
agactggaatgggctgtagt

SEQ ID NO: 486 - DNA, 20 bp, Artificial sequence
  Synthetic oligonucleotide
ttgtcgagactggaatgggc

SEQ ID NO: 487 - DNA, 20 bp, Artificial sequence
  Synthetic oligonucleotide
gcgctgttgtcgagactgga

SEQ ID NO: 488 - DNA, 20 bp, Artificial sequence
  Synthetic oligonucleotide
ggaaatgcgctgttgtcgag

SEQ ID NO: 489 - DNA, 20 bp, Artificial sequence
  Synthetic oligonucleotide
ggcttgtactgaagggtgcg

SEQ ID NO: 490 - DNA, 20 bp, Artificial sequence
  Synthetic oligonucleotide
gtggtgggcttgtactgaag

SEQ ID NO: 491 - DNA, 20 bp, Artificial sequence
  Synthetic oligonucleotide
ctgttggtggtgggcttgta

SEQ ID NO: 492 - DNA, 20 bp, Artificial sequence
  Synthetic oligonucleotide
caactgctgttggtggtggg

SEQ ID NO: 493 - DNA, 20 bp, Artificial sequence
  Synthetic oligonucleotide
gcgctgggttgctttctcgg

SEQ ID NO: 494 - DNA, 20 bp, Artificial sequence
  Synthetic oligonucleotide
ccggccgctggagcgagcgc

SEQ ID NO: 495 - DNA, 20 bp, Artificial sequence
  Synthetic oligonucleotide
agaaggaggacgacgaaggg

SEQ ID NO: 496 - DNA, 20 bp, Artificial sequence
  Synthetic oligonucleotide
aagcctcaagttcctcattg

SEQ ID NO: 497 - DNA, 20 bp, Artificial sequence
  Synthetic oligonucleotide
gctgtgtatttttcttcctc

SEQ ID NO: 498 - DNA, 20 bp, Artificial sequence
  Synthetic oligonucleotide
ctctgttcgatgcaggacta

SEQ ID NO: 499 - DNA, 20 bp, Artificial sequence
  Synthetic oligonucleotide
agaatccttagcacttggtt

SEQ ID NO: 500 - DNA, 20 bp, Artificial sequence
  Synthetic oligonucleotide
ttggcttgattcactggcat

SEQ ID NO: 501 - DNA, 20 bp, Artificial sequence
  Synthetic oligonucleotide
aatttggcctttcggttcct

SEQ ID NO: 502 - DNA, 20 bp, Artificial sequence
  Synthetic oligonucleotide
tgcctctactcggtccaagt

SEQ ID NO: 503 - DNA, 20 bp, Artificial sequence
  Synthetic oligonucleotide
tcttgttacttcttttgcta

SEQ ID NO: 504 - DNA, 20 bp, Artificial sequence
  Synthetic oligonucleotide
cttaacttaaaagttgaacc

SEQ ID NO: 505 - DNA, 20 bp, Artificial sequence
  Synthetic oligonucleotide
tctagcccacaccttgccag

SEQ ID NO: 506 - DNA, 20 bp, Artificial sequence
  Synthetic oligonucleotide
cgaacagcaatgcggatcgg

SEQ ID NO: 507 - DNA, 20 bp, Artificial sequence
  Synthetic oligonucleotide
gaatttccagactttcaagc

SEQ ID NO: 508 - DNA, 20 bp, Artificial sequence
  Synthetic oligonucleotide
taacaaaggatgatgccatt

SEQ ID NO: 509 - DNA, 20 bp, Artificial sequence
  Synthetic oligonucleotide
ttgggcaagtcccctaatct

SEQ ID NO: 510 - DNA, 20 bp, Artificial sequence
  Synthetic oligonucleotide
accagcatgttaggaggcct

SEQ ID NO: 511 - DNA, 20 bp, Artificial sequence
  Synthetic oligonucleotide
tacttctttgggagatataa

SEQ ID NO: 512 - DNA, 20 bp, Artificial sequence
  Synthetic oligonucleotide
cagggtttccccatgttagg

SEQ ID NO: 513 - DNA, 20 bp, Artificial sequence
  Synthetic oligonucleotide
aaggagccaagattgcccca

SEQ ID NO: 514 - DNA, 20 bp, Artificial sequence
  Synthetic oligonucleotide
actgagactgtagatgagcc

SEQ ID NO: 515 - DNA, 20 bp, Artificial sequence
  Synthetic oligonucleotide
aagcaatggaacagttatta

SEQ ID NO: 516 - DNA, 20 bp, Artificial sequence
  Synthetic oligonucleotide
cagtcccctcccagtgctac

SEQ ID NO: 517 - DNA, 20 bp, Artificial sequence
  Synthetic oligonucleotide
gttcaaattccggctccatc

SEQ ID NO: 518 - DNA, 20 bp, Artificial sequence
  Synthetic oligonucleotide
tgtggtaaaaaagcaagaga

SEQ ID NO: 519 - DNA, 20 bp, Artificial sequence
  Synthetic oligonucleotide
aaatcaagcagagccaggtg

SEQ ID NO: 520 - DNA, 20 bp, Artificial sequence
  Synthetic oligonucleotide
tcttggacagagggagtaaa

SEQ ID NO: 521 - DNA, 20 bp, Artificial sequence
  Synthetic oligonucleotide
aaagctccacggaaaacaat

SEQ ID NO: 522 - DNA, 20 bp, Artificial sequence
  Synthetic oligonucleotide
tacatctttgactaataaaa

SEQ ID NO: 523 - DNA, 20 bp, Artificial sequence
  Synthetic oligonucleotide
attatagaatataatacaac

SEQ ID NO: 524 - DNA, 20 bp, Artificial sequence
  Synthetic oligonucleotide
aaaagcacattaattcaaaa

SEQ ID NO: 525 - DNA, 20 bp, Artificial sequence
  Synthetic oligonucleotide
tgtaaattgtcatactgtat

SEQ ID NO: 526 - DNA, 20 bp, Artificial sequence
  Synthetic oligonucleotide
ctacaatttacaacagaatt

SEQ ID NO: 527 - DNA, 20 bp, Artificial sequence
  Synthetic oligonucleotide
gattatagacatgtgccatc

SEQ ID NO: 528 - DNA, 20 bp, Artificial sequence
  Synthetic oligonucleotide
ttctgtaaagagacagtcaa

SEQ ID NO: 529 - DNA, 20 bp, Artificial sequence
  Synthetic oligonucleotide
aaactgtgaacaccatgaaa

SEQ ID NO: 530 - DNA, 20 bp, Artificial sequence
  Synthetic oligonucleotide
gttttgtttaatcacagttt

SEQ ID NO: 531 - DNA, 20 bp, Artificial sequence
  Synthetic oligonucleotide
cattttctccattaggcttc

SEQ ID NO: 532 - DNA, 20 bp, Artificial sequence
  Synthetic oligonucleotide
aaagaaagaagtactaatac

SEQ ID NO: 533 - DNA, 20 bp, Artificial sequence
  Synthetic oligonucleotide
atatactagacaccatggtt

SEQ ID NO: 534 - DNA, 20 bp, Artificial sequence
  Synthetic oligonucleotide
ctgttggcatagtaacatac

SEQ ID NO: 535 - DNA, 20 bp, Artificial sequence
  Synthetic oligonucleotide
taaccatttcttctcaacta

SEQ ID NO: 536 - DNA, 20 bp, Artificial sequence
  Synthetic oligonucleotide
gttgtgttaagagggcatta

SEQ ID NO: 537 - DNA, 20 bp, Artificial sequence
  Synthetic oligonucleotide
ttttgtttttaactttccat

SEQ ID NO: 538 - DNA, 20 bp, Artificial sequence
  Synthetic oligonucleotide
gatatgttacaaattctctt

SEQ ID NO: 539 - DNA, 20 bp, Artificial sequence
  Synthetic oligonucleotide
ctaatgtttcaactcctttt

SEQ ID NO: 540 - DNA, 20 bp, Artificial sequence
  Synthetic oligonucleotide
aaaggaagaggaaatataat

SEQ ID NO: 541 - DNA, 20 bp, Artificial sequence
  Synthetic oligonucleotide
gtcccttcccttagattctg

SEQ ID NO: 542 - DNA, 20 bp, Artificial sequence
  Synthetic oligonucleotide
ctggttccttacaattatct

SEQ ID NO: 543 - DNA, 20 bp, Artificial sequence
  Synthetic oligonucleotide
tttgatatgtggcaatgatg

SEQ ID NO: 544 - DNA, 20 bp, Artificial sequence
  Synthetic oligonucleotide
aacaaagcactaaggactga

SEQ ID NO: 545 - DNA, 20 bp, Artificial sequence
  Synthetic oligonucleotide
accaataattttatttatgt

SEQ ID NO: 546 - DNA, 20 bp, Artificial sequence
  Synthetic oligonucleotide
ttgtatgtgttaactattgt

SEQ ID NO: 547 - DNA, 20 bp, Artificial sequence
  Synthetic oligonucleotide
cagaacaggagaaaacattt

SEQ ID NO: 548 - DNA, 20 bp, Artificial sequence
  Synthetic oligonucleotide
gttagacaagatttaacata

SEQ ID NO: 549 - DNA, 20 bp, Artificial sequence
  Synthetic oligonucleotide
ggtatttatgtgggcacact

SEQ ID NO: 550 - DNA, 20 bp, Artificial sequence
  Synthetic oligonucleotide
aaatgaacaaaacgggagga

SEQ ID NO: 551 - DNA, 20 bp, Artificial sequence
  Synthetic oligonucleotide
aacaatattccatgcaaatg

SEQ ID NO: 552 - DNA, 20 bp, Artificial sequence
  Synthetic oligonucleotide
actgaaagtaaagacccagt

SEQ ID NO: 553 - DNA, 20 bp, Artificial sequence
  Synthetic oligonucleotide
gtgataccctgtctcattta

SEQ ID NO: 554 - DNA, 20 bp, Artificial sequence
  Synthetic oligonucleotide
caactcctaacctcaagtaa

SEQ ID NO: 555 - DNA, 20 bp, Artificial sequence
  Synthetic oligonucleotide
ctaggcatgagaaggtttcc

SEQ ID NO: 556 - DNA, 20 bp, Artificial sequence
  Synthetic oligonucleotide
gttagaatgtgactctccca

SEQ ID NO: 557 - DNA, 20 bp, Artificial sequence
  Synthetic oligonucleotide
ctgggacggctttgaatgtg

SEQ ID NO: 558 - DNA, 20 bp, Artificial sequence
  Synthetic oligonucleotide
caaatttttaaattgttttg

SEQ ID NO: 559 - DNA, 20 bp, Artificial sequence
  Synthetic oligonucleotide
tgaggctgacacaggcagac

SEQ ID NO: 560 - DNA, 20 bp, Artificial sequence
  Synthetic oligonucleotide
cttgatcaagtccctgtaac

SEQ ID NO: 561 - DNA, 20 bp, Artificial sequence
  Synthetic oligonucleotide
atgtagttacatgtaaccat

SEQ ID NO: 562 - DNA, 20 bp, Artificial sequence
  Synthetic oligonucleotide
gcagatttaatgaagaacat

SEQ ID NO: 563 - DNA, 20 bp, Artificial sequence
  Synthetic oligonucleotide
tccattttaaaaactgaatt

SEQ ID NO: 564 - DNA, 20 bp, Artificial sequence
  Synthetic oligonucleotide
aataaaaggcaacttgacca

SEQ ID NO: 565 - DNA, 20 bp, Artificial sequence
  Synthetic oligonucleotide
actgcacccggcctaaaaat

SEQ ID NO: 566 - DNA, 20 bp, Artificial sequence
  Synthetic oligonucleotide
atctcccatctttgctttat

SEQ ID NO: 567 - DNA, 20 bp, Artificial sequence
  Synthetic oligonucleotide
cattccagagtcaaagatat

SEQ ID NO: 568 - DNA, 20 bp, Artificial sequence
  Synthetic oligonucleotide
cacagtcaagtatgtgaatt

SEQ ID NO: 569 - DNA, 20 bp, Artificial sequence
  Synthetic oligonucleotide
gcggcgcgctgggttgcttt

SEQ ID NO: 570 - DNA, 20 bp, Artificial sequence
  Synthetic oligonucleotide
ccgcgccggccgctggagcg

SEQ ID NO: 571 - DNA, 20 bp, Artificial sequence
  Synthetic oligonucleotide
cgggttggcgcggccggagg

SEQ ID NO: 572 - DNA, 20 bp, Artificial sequence
  Synthetic oligonucleotide
cgtcattttccaaagcctca

SEQ ID NO: 573 - DNA, 20 bp, Artificial sequence
  Synthetic oligonucleotide
cgttcactggaatttctctg

SEQ ID NO: 574 - DNA, 20 bp, Artificial sequence
  Synthetic oligonucleotide
agctctgttcgatgcaggac

SEQ ID NO: 575 - DNA, 20 bp, Artificial sequence
  Synthetic oligonucleotide
aaagaatccttagcacttgg

SEQ ID NO: 576 - DNA, 20 bp, Artificial sequence
  Synthetic oligonucleotide
tcttggcttgattcactggc

SEQ ID NO: 577 - DNA, 20 bp, Artificial sequence
  Synthetic oligonucleotide
gagggaatttggcctttcgg

SEQ ID NO: 578 - DNA, 20 bp, Artificial sequence
  Synthetic oligonucleotide
ctaaatgcctctactcggtc

SEQ ID NO: 579 - DNA, 20 bp, Artificial sequence
  Synthetic oligonucleotide
aatagcagcaagaatcactc

SEQ ID NO: 580 - DNA, 20 bp, Artificial sequence
  Synthetic oligonucleotide
tttcccttaacttaaaagtt

SEQ ID NO: 581 - DNA, 20 bp, Artificial sequence
  Synthetic oligonucleotide
gcatctctagcccacacctt

SEQ ID NO: 582 - DNA, 20 bp, Artificial sequence
  Synthetic oligonucleotide
gggagagagccccgacagac

SEQ ID NO: 583 - DNA, 20 bp, Artificial sequence
  Synthetic oligonucleotide
ggcctcgaacagcaatgcgg

SEQ ID NO: 584 - DNA, 20 bp, Artificial sequence
  Synthetic oligonucleotide
ttcttaaagcagatgtgaat

SEQ ID NO: 585 - DNA, 20 bp, Artificial sequence
  Synthetic oligonucleotide
tcaatgtgcacataaaagaa

SEQ ID NO: 586 - DNA, 20 bp, Artificial sequence
  Synthetic oligonucleotide
atcctacaaatattgctttg

SEQ ID NO: 587 - DNA, 20 bp, Artificial sequence
  Synthetic oligonucleotide
ttacaaagacttcattatag

SEQ ID NO: 588 - DNA, 20 bp, Artificial sequence
  Synthetic oligonucleotide
tttcaataatgcaatgcatc

SEQ ID NO: 589 - DNA, 20 bp, Artificial sequence
  Synthetic oligonucleotide
gtcgcccagcaggctggagt

SEQ ID NO: 590 - DNA, 20 bp, Artificial sequence
  Synthetic oligonucleotide
gaaaaaataaaaaggagaga

SEQ ID NO: 591 - DNA, 20 bp, Artificial sequence
  Synthetic oligonucleotide
gagtcactgagactgtagat

SEQ ID NO: 592 - DNA, 20 bp, Artificial sequence
  Synthetic oligonucleotide
ttagaagcaatggaacagtt

SEQ ID NO: 593 - DNA, 20 bp, Artificial sequence
  Synthetic oligonucleotide
ggcagtcccctcccagtgct

SEQ ID NO: 594 - DNA, 20 bp, Artificial sequence
  Synthetic oligonucleotide
caagaactaatatcagcatt

SEQ ID NO: 595 - DNA, 20 bp, Artificial sequence
  Synthetic oligonucleotide
ttcagtagagcaagtaactg

SEQ ID NO: 596 - DNA, 20 bp, Artificial sequence
  Synthetic oligonucleotide
aacagcaatacaacaattaa

SEQ ID NO: 597 - DNA, 20 bp, Artificial sequence
  Synthetic oligonucleotide
gtaacaatcctggattggtt

SEQ ID NO: 598 - DNA, 20 bp, Artificial sequence
  Synthetic oligonucleotide
caaagaagcgcaaatttgat

SEQ ID NO: 599 - DNA, 20 bp, Artificial sequence
  Synthetic oligonucleotide
tcccctttaaataagtcaca

SEQ ID NO: 600 - DNA, 20 bp, Artificial sequence
  Synthetic oligonucleotide
agaaaagatgcagtacacaa

SEQ ID NO: 601 - DNA, 20 bp, Artificial sequence
  Synthetic oligonucleotide
gcagaaaaaaagcacattaa

SEQ ID NO: 602 - DNA, 20 bp, Artificial sequence
  Synthetic oligonucleotide
cgaattacataatacttaag

SEQ ID NO: 603 - DNA, 20 bp, Artificial sequence
  Synthetic oligonucleotide
aaattgtactgaactacaat

SEQ ID NO: 604 - DNA, 20 bp, Artificial sequence
  Synthetic oligonucleotide
gaaaataaagcacaaattct

SEQ ID NO: 605 - DNA, 20 bp, Artificial sequence
  Synthetic oligonucleotide
aatcaaagcatgcaattagt

SEQ ID NO: 606 - DNA, 20 bp, Artificial sequence
  Synthetic oligonucleotide
gctttgctatctctaactct

SEQ ID NO: 607 - DNA, 20 bp, Artificial sequence
  Synthetic oligonucleotide
aattaaacaaattcacagat

SEQ ID NO: 608 - DNA, 20 bp, Artificial sequence
  Synthetic oligonucleotide
tactgtttatgggtgaacat

SEQ ID NO: 609 - DNA, 20 bp, Artificial sequence
  Synthetic oligonucleotide
aaatgtagtgtacctgtgta

SEQ ID NO: 610 - DNA, 20 bp, Artificial sequence
  Synthetic oligonucleotide
atcaccacactccaacctca

SEQ ID NO: 611 - DNA, 20 bp, Artificial sequence
  Synthetic oligonucleotide
tgcagttatcaaaaactaaa

SEQ ID NO: 612 - DNA, 20 bp, Artificial sequence
  Synthetic oligonucleotide
caaaatcctcagctaaccat

SEQ ID NO: 613 - DNA, 20 bp, Artificial sequence
  Synthetic oligonucleotide
agaatttaggttgtgttaag

SEQ ID NO: 614 - DNA, 20 bp, Artificial sequence
  Synthetic oligonucleotide
cagaccggagtgcagtgaca

SEQ ID NO: 615 - DNA, 20 bp, Artificial sequence
  Synthetic oligonucleotide
gaattaatgacatgttgcct

SEQ ID NO: 616 - DNA, 20 bp, Artificial sequence
  Synthetic oligonucleotide
gtaactccacaattctacga

SEQ ID NO: 617 - DNA, 20 bp, Artificial sequence
  Synthetic oligonucleotide
agatcttaaaccaattctac

SEQ ID NO: 618 - DNA, 20 bp, Artificial sequence
  Synthetic oligonucleotide
tgatattgacaagtctggtc

SEQ ID NO: 619 - DNA, 20 bp, Artificial sequence
  Synthetic oligonucleotide
attatatccaattagaaatg

SEQ ID NO: 620 - DNA, 20 bp, Artificial sequence
  Synthetic oligonucleotide
atatgggtggcatttaaatt

SEQ ID NO: 621 - DNA, 20 bp, Artificial sequence
  Synthetic oligonucleotide
ttgtaagctcttgcttacca

SEQ ID NO: 622 - DNA, 20 bp, Artificial sequence
  Synthetic oligonucleotide
gtatgggcatgaaattagac

SEQ ID NO: 623 - DNA, 20 bp, Artificial sequence
  Synthetic oligonucleotide
ttaactgtgttagaatgctt

SEQ ID NO: 624 - DNA, 20 bp, Artificial sequence
  Synthetic oligonucleotide
aaagacaaccaacagaacag

SEQ ID NO: 625 - DNA, 20 bp, Artificial sequence
  Synthetic oligonucleotide
caagctgcctaatatacaca

SEQ ID NO: 626 - DNA, 20 bp, Artificial sequence
  Synthetic oligonucleotide
gctcttggtgtcatggcaaa

SEQ ID NO: 627 - DNA, 20 bp, Artificial sequence
  Synthetic oligonucleotide
caaaagccatactgagcaaa

SEQ ID NO: 628 - DNA, 20 bp, Artificial sequence
  Synthetic oligonucleotide
aagagctggaaaacaatatt

SEQ ID NO: 629 - DNA, 20 bp, Artificial sequence
  Synthetic oligonucleotide
cagcatttctagacacaccc

SEQ ID NO: 630 - DNA, 20 bp, Artificial sequence
  Synthetic oligonucleotide
cacataaaacaatagcacca

SEQ ID NO: 631 - DNA, 20 bp, Artificial sequence
  Synthetic oligonucleotide
aaagacagtagctacttatg

SEQ ID NO: 632 - DNA, 20 bp, Artificial sequence
  Synthetic oligonucleotide
agctaggcatgagaaggttt

SEQ ID NO: 633 - DNA, 20 bp, Artificial sequence
  Synthetic oligonucleotide
ttaaaaagacagtacctcct

SEQ ID NO: 634 - DNA, 20 bp, Artificial sequence
  Synthetic oligonucleotide
tacactgtttaggacacaca

SEQ ID NO: 635 - DNA, 20 bp, Artificial sequence
  Synthetic oligonucleotide
cacacactttaaatacaggg

SEQ ID NO: 636 - DNA, 20 bp, Artificial sequence
  Synthetic oligonucleotide
tcatttcttctcaagttaat

SEQ ID NO: 637 - DNA, 20 bp, Artificial sequence
  Synthetic oligonucleotide
ccctcagacttgatcaagtc

SEQ ID NO: 638 - DNA, 20 bp, Artificial sequence
  Synthetic oligonucleotide
aatgcccatgtagttacatg

SEQ ID NO: 639 - DNA, 20 bp, Artificial sequence
  Synthetic oligonucleotide
atcactgcagatttaatgaa

SEQ ID NO: 640 - DNA, 20 bp, Artificial sequence
  Synthetic oligonucleotide
aaaaattgatttctgaaaca

SEQ ID NO: 641 - DNA, 20 bp, Artificial sequence
  Synthetic oligonucleotide
gcacaagtcataagagatca

SEQ ID NO: 642 - DNA, 20 bp, Artificial sequence
  Synthetic oligonucleotide
gggattacctggctaatttt

SEQ ID NO: 643 - DNA, 20 bp, Artificial sequence
  Synthetic oligonucleotide
tatggtatgtggcaaggcca

SEQ ID NO: 644 - DNA, 20 bp, Artificial sequence
  Synthetic oligonucleotide
aggaaagaaggactgggttg

SEQ ID NO: 645 - DNA, 20 bp, Artificial sequence
  Synthetic oligonucleotide
ttttgcagataacatccctt

SEQ ID NO: 646 - DNA, 20 bp, Artificial sequence
  Synthetic oligonucleotide
aggagcgggcggcgcgctgg

SEQ ID NO: 647 - DNA, 20 bp, Artificial sequence
  Synthetic oligonucleotide
ctccgccgcgccggccgctg

SEQ ID NO: 648 - DNA, 20 bp, Artificial sequence
  Synthetic oligonucleotide
aggcgcgggttggcgcggcc

SEQ ID NO: 649 - DNA, 20 bp, Artificial sequence
  Synthetic oligonucleotide
cgtagacactacaccataat

SEQ ID NO: 650 - DNA, 20 bp, Artificial sequence
  Synthetic oligonucleotide
tctatttctttgtccaggag

SEQ ID NO: 651 - DNA, 20 bp, Artificial sequence
  Synthetic oligonucleotide
cagctctgttcgatgcagga

SEQ ID NO: 652 - DNA, 20 bp, Artificial sequence
  Synthetic oligonucleotide
gaaagaatccttagcacttg

SEQ ID NO: 653 - DNA, 20 bp, Artificial sequence
  Synthetic oligonucleotide
gtcttggcttgattcactgg

SEQ ID NO: 654 - DNA, 20 bp, Artificial sequence
  Synthetic oligonucleotide
aagcagtagaagggaggagg

SEQ ID NO: 655 - DNA, 20 bp, Artificial sequence
  Synthetic oligonucleotide
agttcctaaatgcctctact

SEQ ID NO: 656 - DNA, 20 bp, Artificial sequence
  Synthetic oligonucleotide
gcagtaatagcagcaagaat

SEQ ID NO: 657 - DNA, 20 bp, Artificial sequence
  Synthetic oligonucleotide
aagtttttcccttaacttaa

SEQ ID NO: 658 - DNA, 20 bp, Artificial sequence
  Synthetic oligonucleotide
gagtcgcatctctagcccac

SEQ ID NO: 659 - DNA, 20 bp, Artificial sequence
  Synthetic oligonucleotide
cacttgtctccaccccgtcc

SEQ ID NO: 660 - DNA, 20 bp, Artificial sequence
  Synthetic oligonucleotide
ttctccactgcggcctcgaa

SEQ ID NO: 661 - DNA, 20 bp, Artificial sequence
  Synthetic oligonucleotide
attatgaaatgtttcttaaa

SEQ ID NO: 662 - DNA, 20 bp, Artificial sequence
  Synthetic oligonucleotide
tttttggtctaacttcagag

SEQ ID NO: 663 - DNA, 20 bp, Artificial sequence
  Synthetic oligonucleotide
gagaggtgtaataaaatcct

SEQ ID NO: 664 - DNA, 20 bp, Artificial sequence
  Synthetic oligonucleotide
tgttcaataaagcctctcaa

SEQ ID NO: 665 - DNA, 20 bp, Artificial sequence
  Synthetic oligonucleotide
aattatttcaataatgcaat

SEQ ID NO: 666 - DNA, 20 bp, Artificial sequence
  Synthetic oligonucleotide
aacagaaaatattaagactt

SEQ ID NO: 667 - DNA, 20 bp, Artificial sequence
  Synthetic oligonucleotide
cagctactaaggaggcagaa

SEQ ID NO: 668 - DNA, 20 bp, Artificial sequence
  Synthetic oligonucleotide
tgagtcactgagactgtaga

SEQ ID NO: 669 - DNA, 20 bp, Artificial sequence
  Synthetic oligonucleotide
ccggattgttttcttcatta

SEQ ID NO: 670 - DNA, 20 bp, Artificial sequence
  Synthetic oligonucleotide
attttgaagccctttttctt

SEQ ID NO: 671 - DNA, 20 bp, Artificial sequence
  Synthetic oligonucleotide
acaattaccattcacacaag

SEQ ID NO: 672 - DNA, 20 bp, Artificial sequence
  Synthetic oligonucleotide
cgcccgccaccacatccccg

SEQ ID NO: 673 - DNA, 20 bp, Artificial sequence
  Synthetic oligonucleotide
gtttgcccatcctcacactg

SEQ ID NO: 674 - DNA, 20 bp, Artificial sequence
  Synthetic oligonucleotide
atacatgataaccgaaggta

SEQ ID NO: 675 - DNA, 20 bp, Artificial sequence
  Synthetic oligonucleotide
ggaaagagagctgggaggac

SEQ ID NO: 676 - DNA, 20 bp, Artificial sequence
  Synthetic oligonucleotide
aagctatataaaagacttaa

SEQ ID NO: 677 - DNA, 20 bp, Artificial sequence
  Synthetic oligonucleotide
ctttccttgccaactctctc

SEQ ID NO: 678 - DNA, 20 bp, Artificial sequence
  Synthetic oligonucleotide
taagaccagaaagccaaagg

SEQ ID NO: 679 - DNA, 20 bp, Artificial sequence
  Synthetic oligonucleotide
ccaggacctccttcagatac

SEQ ID NO: 680 - DNA, 20 bp, Artificial sequence
  Synthetic oligonucleotide
ctcctaagtctaagagaaag

SEQ ID NO: 681 - DNA, 20 bp, Artificial sequence
  Synthetic oligonucleotide
aacactctatctatccattc

SEQ ID NO: 682 - DNA, 20 bp, Artificial sequence
  Synthetic oligonucleotide
tgatttttcactaaatgtga

SEQ ID NO: 683 - DNA, 20 bp, Artificial sequence
  Synthetic oligonucleotide
cacaccagcacaccaggcta

SEQ ID NO: 684 - DNA, 20 bp, Artificial sequence
  Synthetic oligonucleotide
cttataaagtccttctccac

SEQ ID NO: 685 - DNA, 20 bp, Artificial sequence
  Synthetic oligonucleotide
tttagaaatggtatcagtta

SEQ ID NO: 686 - DNA, 20 bp, Artificial sequence
  Synthetic oligonucleotide
taaacaaaatgtagtgtacc

SEQ ID NO: 687 - DNA, 20 bp, Artificial sequence
  Synthetic oligonucleotide
aaaaaacagttattccctgg

SEQ ID NO: 688 - DNA, 20 bp, Artificial sequence
  Synthetic oligonucleotide
attcagaatgtacttaaatt

SEQ ID NO: 689 - DNA, 20 bp, Artificial sequence
  Synthetic oligonucleotide
taaaaactataaaatgacat

SEQ ID NO: 690 - DNA, 20 bp, Artificial sequence
  Synthetic oligonucleotide
cagaatttaggttgtgttaa

SEQ ID NO: 691 - DNA, 20 bp, Artificial sequence
  Synthetic oligonucleotide
gagatggagcttgctctttc

SEQ ID NO: 692 - DNA, 20 bp, Artificial sequence
  Synthetic oligonucleotide
aaagtttgagaattaatgac

SEQ ID NO: 693 - DNA, 20 bp, Artificial sequence
  Synthetic oligonucleotide
ctcagaagtggcaactctgg

SEQ ID NO: 694 - DNA, 20 bp, Artificial sequence
  Synthetic oligonucleotide
acagatcttaaaccaattct

SEQ ID NO: 695 - DNA, 20 bp, Artificial sequence
  Synthetic oligonucleotide
tatgtaaactattttaagta

SEQ ID NO: 696 - DNA, 20 bp, Artificial sequence
  Synthetic oligonucleotide
gataatttcacataataaat

SEQ ID NO: 697 - DNA, 20 bp, Artificial sequence
  Synthetic oligonucleotide
gaaaacaggtttttaatata

SEQ ID NO: 698 - DNA, 20 bp, Artificial sequence
  Synthetic oligonucleotide
tgtttgtttgttttaagtat

SEQ ID NO: 699 - DNA, 20 bp, Artificial sequence
  Synthetic oligonucleotide
actgtatacataacgcattt

SEQ ID NO: 700 - DNA, 20 bp, Artificial sequence
  Synthetic oligonucleotide
cgtctgtggagaaagaagta

SEQ ID NO: 701 - DNA, 20 bp, Artificial sequence
  Synthetic oligonucleotide
aaaatcagataaattggact

SEQ ID NO: 702 - DNA, 20 bp, Artificial sequence
  Synthetic oligonucleotide
ttgcccaagctgcctaatat

SEQ ID NO: 703 - DNA, 20 bp, Artificial sequence
  Synthetic oligonucleotide
ttaggacaacggacctaagc

SEQ ID NO: 704 - DNA, 20 bp, Artificial sequence
  Synthetic oligonucleotide
agcaaaagccatactgagca

SEQ ID NO: 705 - DNA, 20 bp, Artificial sequence
  Synthetic oligonucleotide
aaatcacacatagactaaaa

SEQ ID NO: 706 - DNA, 20 bp, Artificial sequence
  Synthetic oligonucleotide
tcagccccagtacaataaag

SEQ ID NO: 707 - DNA, 20 bp, Artificial sequence
  Synthetic oligonucleotide
taagtaaaaggaagagtatg

SEQ ID NO: 708 - DNA, 20 bp, Artificial sequence
  Synthetic oligonucleotide
gctgaaaagacagtagctac

SEQ ID NO: 709 - DNA, 20 bp, Artificial sequence
  Synthetic oligonucleotide
gctagagagctaggcatgag

SEQ ID NO: 710 - DNA, 20 bp, Artificial sequence
  Synthetic oligonucleotide
atcatttctattaaaaagac

SEQ ID NO: 711 - DNA, 20 bp, Artificial sequence
  Synthetic oligonucleotide
attactacactgtttaggac

SEQ ID NO: 712 - DNA, 20 bp, Artificial sequence
  Synthetic oligonucleotide
cacaaaaagacacttgttat

SEQ ID NO: 713 - DNA, 20 bp, Artificial sequence
  Synthetic oligonucleotide
aaaaaatgtacaaaacctta

SEQ ID NO: 714 - DNA, 20 bp, Artificial sequence
  Synthetic oligonucleotide
attctgcttcatccttcagg

SEQ ID NO: 715 - DNA, 20 bp, Artificial sequence
  Synthetic oligonucleotide
gttcaggacatctaaactta

SEQ ID NO: 716 - DNA, 20 bp, Artificial sequence
  Synthetic oligonucleotide
aaggctttgaaagtctaata

SEQ ID NO: 717 - DNA, 20 bp, Artificial sequence
  Synthetic oligonucleotide
ataccaagcttgtggcttgg

SEQ ID NO: 718 - DNA, 20 bp, Artificial sequence
  Synthetic oligonucleotide
atgcacaagtcataagagat

SEQ ID NO: 719 - DNA, 20 bp, Artificial sequence
  Synthetic oligonucleotide
ttgtttaatttttgacagag

SEQ ID NO: 720 - DNA, 20 bp, Artificial sequence
  Synthetic oligonucleotide
tggagcaatgtcctgagggc

SEQ ID NO: 721 - DNA, 20 bp, Artificial sequence
  Synthetic oligonucleotide
atatagacatagcaaagcag

SEQ ID NO: 722 - DNA, 20 bp, Artificial sequence
  Synthetic oligonucleotide
atgcttcagaatcaggctgc

SEQ ID NO: 723 - DNA, 20 bp, Artificial sequence
  Synthetic oligonucleotide
ctttaccggaagtcggaggg

SEQ ID NO: 724 - DNA, 20 bp, Artificial sequence
  Synthetic oligonucleotide
gcccgctccgccgcgccggc

SEQ ID NO: 725 - DNA, 20 bp, Artificial sequence
  Synthetic oligonucleotide
cgggcgcgccaaggagacgc

SEQ ID NO: 726 - DNA, 20 bp, Artificial sequence
  Synthetic oligonucleotide
ggcactgtatacgaagataa

SEQ ID NO: 727 - DNA, 20 bp, Artificial sequence
  Synthetic oligonucleotide
tctctatttctttgtccagg

SEQ ID NO: 728 - DNA, 20 bp, Artificial sequence
  Synthetic oligonucleotide
acagctctgttcgatgcagg

SEQ ID NO: 729 - DNA, 20 bp, Artificial sequence
  Synthetic oligonucleotide
tgaaagaatccttagcactt

SEQ ID NO: 730 - DNA, 20 bp, Artificial sequence
  Synthetic oligonucleotide
tgtcttggcttgattcactg

SEQ ID NO: 731 - DNA, 20 bp, Artificial sequence
  Synthetic oligonucleotide
ggtagaagcagtagaaggga

SEQ ID NO: 732 - DNA, 20 bp, Artificial sequence
  Synthetic oligonucleotide
ccccaagttcctaaatgcct

SEQ ID NO: 733 - DNA, 20 bp, Artificial sequence
  Synthetic oligonucleotide
ttttagcagtaatagcagca

SEQ ID NO: 734 - DNA, 20 bp, Artificial sequence
  Synthetic oligonucleotide
agtaaaagtttttcccttaa

SEQ ID NO: 735 - DNA, 20 bp, Artificial sequence
  Synthetic oligonucleotide
caactgagtcgcatctctag

SEQ ID NO: 736 - DNA, 20 bp, Artificial sequence
  Synthetic oligonucleotide
aggcccacttgtctccaccc

SEQ ID NO: 737 - DNA, 20 bp, Artificial sequence
  Synthetic oligonucleotide
gcgccttctccactgcggcc

SEQ ID NO: 738 - DNA, 20 bp, Artificial sequence
  Synthetic oligonucleotide
ttatctttcctaaaacagcc

SEQ ID NO: 739 - DNA, 20 bp, Artificial sequence
  Synthetic oligonucleotide
aatgtcaattaacttttttg

SEQ ID NO: 740 - DNA, 20 bp, Artificial sequence
  Synthetic oligonucleotide
gacaggagaaatgcttggcc

SEQ ID NO: 741 - DNA, 20 bp, Artificial sequence
  Synthetic oligonucleotide
cattggcaacactgttcaat

SEQ ID NO: 742 - DNA, 20 bp, Artificial sequence
  Synthetic oligonucleotide
aacaattatttcaataatgc

SEQ ID NO: 743 - DNA, 20 bp, Artificial sequence
  Synthetic oligonucleotide
cataaaaacagaaaatatta

SEQ ID NO: 744 - DNA, 20 bp, Artificial sequence
  Synthetic oligonucleotide
aagatgacaacggaacggga

SEQ ID NO: 745 - DNA, 20 bp, Artificial sequence
  Synthetic oligonucleotide
ctgcacgccactgtactcca

SEQ ID NO: 746 - DNA, 20 bp, Artificial sequence
  Synthetic oligonucleotide
ctgacaataatcaccggatt

SEQ ID NO: 747 - DNA, 20 bp, Artificial sequence
  Synthetic oligonucleotide
ccatctcaactctcattatt

SEQ ID NO: 748 - DNA, 20 bp, Artificial sequence
  Synthetic oligonucleotide
gccagattaatccggtcata

SEQ ID NO: 749 - DNA, 20 bp, Artificial sequence
  Synthetic oligonucleotide
attctgtaaggctactactg

SEQ ID NO: 750 - DNA, 20 bp, Artificial sequence
  Synthetic oligonucleotide
tgatttttatgttcctcaag

SEQ ID NO: 751 - DNA, 20 bp, Artificial sequence
  Synthetic oligonucleotide
atctgaatctaatcataagg

SEQ ID NO: 752 - DNA, 20 bp, Artificial sequence
  Synthetic oligonucleotide
ggccagaactagggaaagag

SEQ ID NO: 753 - DNA, 20 bp, Artificial sequence
  Synthetic oligonucleotide
cacgaactgtccttaaactc

SEQ ID NO: 754 - DNA, 20 bp, Artificial sequence
  Synthetic oligonucleotide
tcatatgattacaactgcag

SEQ ID NO: 755 - DNA, 20 bp, Artificial sequence
  Synthetic oligonucleotide
taacattccaaaatttaaga

SEQ ID NO: 756 - DNA, 20 bp, Artificial sequence
  Synthetic oligonucleotide
acaatacactgaactcttga

SEQ ID NO: 757 - DNA, 20 bp, Artificial sequence
  Synthetic oligonucleotide
aatacccagtactgttagcc

SEQ ID NO: 758 - DNA, 20 bp, Artificial sequence
  Synthetic oligonucleotide
tgaaatcaattcatatcttt

SEQ ID NO: 759 - DNA, 20 bp, Artificial sequence
  Synthetic oligonucleotide
atggagatcttttccattaa

SEQ ID NO: 760 - DNA, 20 bp, Artificial sequence
  Synthetic oligonucleotide
tactaaaatctacacaattc

SEQ ID NO: 761 - DNA, 20 bp, Artificial sequence
  Synthetic oligonucleotide
agtcatgcttataaagtcct

SEQ ID NO: 762 - DNA, 20 bp, Artificial sequence
  Synthetic oligonucleotide
acttaaaatttgaactgaaa

SEQ ID NO: 763 - DNA, 20 bp, Artificial sequence
  Synthetic oligonucleotide
acccggcccacacaaaaact

SEQ ID NO: 764 - DNA, 20 bp, Artificial sequence
  Synthetic oligonucleotide
ggttcaagcaaattgcttgt

SEQ ID NO: 765 - DNA, 20 bp, Artificial sequence
  Synthetic oligonucleotide
gtatgatgacaaaagaggac

SEQ ID NO: 766 - DNA, 20 bp, Artificial sequence
  Synthetic oligonucleotide
ttttaaagggccagaataat

SEQ ID NO: 767 - DNA, 20 bp, Artificial sequence
  Synthetic oligonucleotide
ctgaccagaatttaggttgt

SEQ ID NO: 768 - DNA, 20 bp, Artificial sequence
  Synthetic oligonucleotide
tttgagatggagcttgctct

SEQ ID NO: 769 - DNA, 20 bp, Artificial sequence
  Synthetic oligonucleotide
cattatattaggttatatat

SEQ ID NO: 770 - DNA, 20 bp, Artificial sequence
  Synthetic oligonucleotide
aaatggttttaccattagca

SEQ ID NO: 771 - DNA, 20 bp, Artificial sequence
  Synthetic oligonucleotide
tttccaagatcaccataacc

SEQ ID NO: 772 - DNA, 20 bp, Artificial sequence
  Synthetic oligonucleotide
tatgtctaaaaaattttatt

SEQ ID NO: 773 - DNA, 20 bp, Artificial sequence
  Synthetic oligonucleotide
agggttaattaggatctata

SEQ ID NO: 774 - DNA, 20 bp, Artificial sequence
  Synthetic oligonucleotide
aacttgctcttcaaggttag

SEQ ID NO: 775 - DNA, 20 bp, Artificial sequence
  Synthetic oligonucleotide
ttttaaaggttctctggact

SEQ ID NO: 776 - DNA, 20 bp, Artificial sequence
  Synthetic oligonucleotide
tatggtttgatgtttctgac

SEQ ID NO: 777 - DNA, 20 bp, Artificial sequence
  Synthetic oligonucleotide
ccctccccctccttctcctt

SEQ ID NO: 778 - DNA, 20 bp, Artificial sequence
  Synthetic oligonucleotide
aaagaaaaaaaaagttgctc

SEQ ID NO: 779 - DNA, 20 bp, Artificial sequence
  Synthetic oligonucleotide
ttaacttctctttgcccaag

SEQ ID NO: 780 - DNA, 20 bp, Artificial sequence
  Synthetic oligonucleotide
agtacaagcaacaaaaacag

SEQ ID NO: 781 - DNA, 20 bp, Artificial sequence
  Synthetic oligonucleotide
aaagagcaaaagccatactg

SEQ ID NO: 782 - DNA, 20 bp, Artificial sequence
  Synthetic oligonucleotide
acacactttacctataaaat

SEQ ID NO: 783 - DNA, 20 bp, Artificial sequence
  Synthetic oligonucleotide
tgtgccagcttcagatatga

SEQ ID NO: 784 - DNA, 20 bp, Artificial sequence
  Synthetic oligonucleotide
aatagtctaagtaaaaggaa

SEQ ID NO: 785 - DNA, 20 bp, Artificial sequence
  Synthetic oligonucleotide
ctggccaatcaacaaacact

SEQ ID NO: 786 - DNA, 20 bp, Artificial sequence
  Synthetic oligonucleotide
gttttatattgctagagagc

SEQ ID NO: 787 - DNA, 20 bp, Artificial sequence
  Synthetic oligonucleotide
tgctcccagcctcatatgaa

SEQ ID NO: 788 - DNA, 20 bp, Artificial sequence
  Synthetic oligonucleotide
ttaaaaaaatgaaatatgca

SEQ ID NO: 789 - DNA, 20 bp, Artificial sequence
  Synthetic oligonucleotide
cagaaacaaattcaaccaca

SEQ ID NO: 790 - DNA, 20 bp, Artificial sequence
  Synthetic oligonucleotide
aaaagaacctacctaaggca

SEQ ID NO: 791 - DNA, 20 bp, Artificial sequence
  Synthetic oligonucleotide
tattaaaagtttttttatat

SEQ ID NO: 792 - DNA, 20 bp, Artificial sequence
  Synthetic oligonucleotide
ccagaaatctgtaaattctt

SEQ ID NO: 793 - DNA, 20 bp, Artificial sequence
  Synthetic oligonucleotide
tgtacttcaaattttgttta

SEQ ID NO: 794 - DNA, 20 bp, Artificial sequence
  Synthetic oligonucleotide
tataccaagcttgtggcttg

SEQ ID NO: 795 - DNA, 20 bp, Artificial sequence
  Synthetic oligonucleotide
gtttaatttgtaactaggtt

SEQ ID NO: 796 - DNA, 20 bp, Artificial sequence
  Synthetic oligonucleotide
atgtatttatttgtttaatt

SEQ ID NO: 797 - DNA, 20 bp, Artificial sequence
  Synthetic oligonucleotide
caagtgcattttaggtgcac

SEQ ID NO: 798 - DNA, 20 bp, Artificial sequence
  Synthetic oligonucleotide
ctatatagacatagcaaagc

SEQ ID NO: 799 - DNA, 20 bp, Artificial sequence
  Synthetic oligonucleotide
atatcatacaagattcaatg

SEQ ID NO: 800 - DNA, 20 bp, Artificial sequence
  Synthetic oligonucleotide
ggactctttaccggaagtcg

SEQ ID NO: 801 - DNA, 20 bp, Artificial sequence
  Synthetic oligonucleotide
gccccgcccgctccgccgcg

SEQ ID NO: 802 - DNA, 20 bp, Artificial sequence
  Synthetic oligonucleotide
ggagccgggcgcgccaagga

SEQ ID NO: 803 - DNA, 20 bp, Artificial sequence
  Synthetic oligonucleotide
ttgcccttgcttcccgtttt

SEQ ID NO: 804 - DNA, 20 bp, Artificial sequence
  Synthetic oligonucleotide
ttctctatttctttgtccag

SEQ ID NO: 805 - DNA, 20 bp, Artificial sequence
  Synthetic oligonucleotide
taacagctctgttcgatgca

SEQ ID NO: 806 - DNA, 20 bp, Artificial sequence
  Synthetic oligonucleotide
aatgaaagaatccttagcac

SEQ ID NO: 807 - DNA, 20 bp, Artificial sequence
  Synthetic oligonucleotide
tatgtcttggcttgattcac

SEQ ID NO: 808 - DNA, 20 bp, Artificial sequence
  Synthetic oligonucleotide
cagttggtagaagcagtaga

SEQ ID NO: 809 - DNA, 20 bp, Artificial sequence
  Synthetic oligonucleotide
atagcccccaagttcctaaa

SEQ ID NO: 810 - DNA, 20 bp, Artificial sequence
  Synthetic oligonucleotide
tttttttttagcagtaatag

SEQ ID NO: 811 - DNA, 20 bp, Artificial sequence
  Synthetic oligonucleotide
tacaaagtaaaagtttttcc

SEQ ID NO: 812 - DNA, 20 bp, Artificial sequence
  Synthetic oligonucleotide
agatccaactgagtcgcatc

SEQ ID NO: 813 - DNA, 20 bp, Artificial sequence
  Synthetic oligonucleotide
tcggacacgaacgcagaggg

SEQ ID NO: 814 - DNA, 20 bp, Artificial sequence
  Synthetic oligonucleotide
ttcgacctcgatgttccaca

SEQ ID NO: 815 - DNA, 20 bp, Artificial sequence
  Synthetic oligonucleotide
caaaattagattacagtaaa

SEQ ID NO: 816 - DNA, 20 bp, Artificial sequence
  Synthetic oligonucleotide
aacaaaacatgtctctttgg

SEQ ID NO: 817 - DNA, 20 bp, Artificial sequence
  Synthetic oligonucleotide
cagcatgatcttgtgtatat

SEQ ID NO: 818 - DNA, 20 bp, Artificial sequence
  Synthetic oligonucleotide
aaggaaatttaaaaaaaaac

SEQ ID NO: 819 - DNA, 20 bp, Artificial sequence
  Synthetic oligonucleotide
cctcggcaactaagagcgaa

SEQ ID NO: 820 - DNA, 20 bp, Artificial sequence
  Synthetic oligonucleotide
tcccatctcaaaaaataaat

SEQ ID NO: 821 - DNA, 20 bp, Artificial sequence
  Synthetic oligonucleotide
aggtactcagcaagctgagg

SEQ ID NO: 822 - DNA, 20 bp, Artificial sequence
  Synthetic oligonucleotide
gccactttggaaggtcgagg

SEQ ID NO: 823 - DNA, 20 bp, Artificial sequence
  Synthetic oligonucleotide
aaagcatggttgattgaaga

SEQ ID NO: 824 - DNA, 20 bp, Artificial sequence
  Synthetic oligonucleotide
ctaaagctgagtgacaggta

SEQ ID NO: 825 - DNA, 20 bp, Artificial sequence
  Synthetic oligonucleotide
cttgttgttgtttacattat

SEQ ID NO: 826 - DNA, 20 bp, Artificial sequence
  Synthetic oligonucleotide
aagaaatacattctgtaagg

SEQ ID NO: 827 - DNA, 20 bp, Artificial sequence
  Synthetic oligonucleotide
aaactttccatttcaaagct

SEQ ID NO: 828 - DNA, 20 bp, Artificial sequence
  Synthetic oligonucleotide
aacttagtagacacaactct

SEQ ID NO: 829 - DNA, 20 bp, Artificial sequence
  Synthetic oligonucleotide
gctaaattgtagttgtctag

SEQ ID NO: 830 - DNA, 20 bp, Artificial sequence
  Synthetic oligonucleotide
tctggtatcctggtggctgc

SEQ ID NO: 831 - DNA, 20 bp, Artificial sequence
  Synthetic oligonucleotide
aaagaaaaacaggtcatatg

SEQ ID NO: 832 - DNA, 20 bp, Artificial sequence
  Synthetic oligonucleotide
ttctgcccttcatgtccggt

SEQ ID NO: 833 - DNA, 20 bp, Artificial sequence
  Synthetic oligonucleotide
atattaggtattcactaaca

SEQ ID NO: 834 - DNA, 20 bp, Artificial sequence
  Synthetic oligonucleotide
ggcctcttaagacaaaaagt

SEQ ID NO: 835 - DNA, 20 bp, Artificial sequence
  Synthetic oligonucleotide
agctcagaaatgaaatcaat

SEQ ID NO: 836 - DNA, 20 bp, Artificial sequence
  Synthetic oligonucleotide
accagcctgtgcaatacagg

SEQ ID NO: 837 - DNA, 20 bp, Artificial sequence
  Synthetic oligonucleotide
tatttctcactgttctctaa

SEQ ID NO: 838 - DNA, 20 bp, Artificial sequence
  Synthetic oligonucleotide
cttttacttcatgatttttt

SEQ ID NO: 839 - DNA, 20 bp, Artificial sequence
  Synthetic oligonucleotide
agtaattttatgtttttaaa

SEQ ID NO: 840 - DNA, 20 bp, Artificial sequence
  Synthetic oligonucleotide
tccacacgcagttttttttt

SEQ ID NO: 841 - DNA, 20 bp, Artificial sequence
  Synthetic oligonucleotide
tttcccatataatttttttt

SEQ ID NO: 842 - DNA, 20 bp, Artificial sequence
  Synthetic oligonucleotide
caggtggagccacgctcctc

SEQ ID NO: 843 - DNA, 20 bp, Artificial sequence
  Synthetic oligonucleotide
gggtatccccagccccatac

SEQ ID NO: 844 - DNA, 20 bp, Artificial sequence
  Synthetic oligonucleotide
tagaagctcagtattaaaaa

SEQ ID NO: 845 - DNA, 20 bp, Artificial sequence
  Synthetic oligonucleotide
gtaattactctgcatgtctc

SEQ ID NO: 846 - DNA, 20 bp, Artificial sequence
  Synthetic oligonucleotide
cgtgatgtacagacttgaga

SEQ ID NO: 847 - DNA, 20 bp, Artificial sequence
  Synthetic oligonucleotide
ctttagaaatggttttacca

SEQ ID NO: 848 - DNA, 20 bp, Artificial sequence
  Synthetic oligonucleotide
gctcttcaagatcttggatt

SEQ ID NO: 849 - DNA, 20 bp, Artificial sequence
  Synthetic oligonucleotide
ttgcacataggttagaattt

SEQ ID NO: 850 - DNA, 20 bp, Artificial sequence
  Synthetic oligonucleotide
aaagggttaattaggatcta

SEQ ID NO: 851 - DNA, 20 bp, Artificial sequence
  Synthetic oligonucleotide
tctttagaagaatgctaatg

SEQ ID NO: 852 - DNA, 20 bp, Artificial sequence
  Synthetic oligonucleotide
ggccgatcttgtttctttta

SEQ ID NO: 853 - DNA, 20 bp, Artificial sequence
  Synthetic oligonucleotide
tattgttgttaccaaatctc

SEQ ID NO: 854 - DNA, 20 bp, Artificial sequence
  Synthetic oligonucleotide
ggaagaatacctacagcaag

SEQ ID NO: 855 - DNA, 20 bp, Artificial sequence
  Synthetic oligonucleotide
ctgagcaccaagtcactctc

SEQ ID NO: 856 - DNA, 20 bp, Artificial sequence
  Synthetic oligonucleotide
tgcactatgcattagttact

SEQ ID NO: 857 - DNA, 20 bp, Artificial sequence
  Synthetic oligonucleotide
caaaagaaagaaaacaggaa

SEQ ID NO: 858 - DNA, 20 bp, Artificial sequence
  Synthetic oligonucleotide
caaaaggcccaaaagagcaa

SEQ ID NO: 859 - DNA, 20 bp, Artificial sequence
  Synthetic oligonucleotide
taacaaaatggtagtagtta

SEQ ID NO: 860 - DNA, 20 bp, Artificial sequence
  Synthetic oligonucleotide
ctagacatattctggaccag

SEQ ID NO: 861 - DNA, 20 bp, Artificial sequence
  Synthetic oligonucleotide
gatggagaatagtctaagta

SEQ ID NO: 862 - DNA, 20 bp, Artificial sequence
  Synthetic oligonucleotide
tggccacgctgaccttaagt

SEQ ID NO: 863 - DNA, 20 bp, Artificial sequence
  Synthetic oligonucleotide
actcttagttttatattgct

SEQ ID NO: 864 - DNA, 20 bp, Artificial sequence
  Synthetic oligonucleotide
gttcaagcgattctgatgct

SEQ ID NO: 865 - DNA, 20 bp, Artificial sequence
  Synthetic oligonucleotide
cttattaattgaaatatgta

SEQ ID NO: 866 - DNA, 20 bp, Artificial sequence
  Synthetic oligonucleotide
gttggttttaaaaaggcaac

SEQ ID NO: 867 - DNA, 20 bp, Artificial sequence
  Synthetic oligonucleotide
gagaagtccctgggttacac

SEQ ID NO: 868 - DNA, 20 bp, Artificial sequence
  Synthetic oligonucleotide
aattataaaggaaaatccct

SEQ ID NO: 869 - DNA, 20 bp, Artificial sequence
  Synthetic oligonucleotide
tatgaaaagtagtaatgtct

SEQ ID NO: 870 - DNA, 20 bp, Artificial sequence
  Synthetic oligonucleotide
ttataaaatataaattgttc

SEQ ID NO: 871 - DNA, 20 bp, Artificial sequence
  Synthetic oligonucleotide
ttataccaagcttgtggctt

SEQ ID NO: 872 - DNA, 20 bp, Artificial sequence
  Synthetic oligonucleotide
cagaaagctgtgtgtttaat

SEQ ID NO: 873 - DNA, 20 bp, Artificial sequence
  Synthetic oligonucleotide
cgaacctgagtttgttgtac

SEQ ID NO: 874 - DNA, 20 bp, Artificial sequence
  Synthetic oligonucleotide
aaaaggcaacttgaaggcat

SEQ ID NO: 875 - DNA, 20 bp, Artificial sequence
  Synthetic oligonucleotide
tgtacacatatatatagtag

SEQ ID NO: 876 - DNA, 20 bp, Artificial sequence
  Synthetic oligonucleotide
caacttaatatcatacaaga

SEQ ID NO: 877 - DNA, 20 bp, Artificial sequence
  Synthetic oligonucleotide
gatagggactctttaccgga

SEQ ID NO: 878 - DNA, 20 bp, Artificial sequence
  Synthetic oligonucleotide
ccgccgccccgcccgctccg

SEQ ID NO: 879 - DNA, 20 bp, Artificial sequence
  Synthetic oligonucleotide
gccgctgccgccgggcttgc

SEQ ID NO: 880 - DNA, 20 bp, Artificial sequence
  Synthetic oligonucleotide
gtttgcccttgcttcccgtt

SEQ ID NO: 881 - DNA, 20 bp, Artificial sequence
  Synthetic oligonucleotide
cttctctatttctttgtcca

SEQ ID NO: 882 - DNA, 20 bp, Artificial sequence
  Synthetic oligonucleotide
gtaacagctctgttcgatgc

SEQ ID NO: 883 - DNA, 20 bp, Artificial sequence
  Synthetic oligonucleotide
gtgttactaagtattgaagg

SEQ ID NO: 884 - DNA, 20 bp, Artificial sequence
  Synthetic oligonucleotide
tgtgttggtggtgccatcat

SEQ ID NO: 885 - DNA, 20 bp, Artificial sequence
  Synthetic oligonucleotide
gcttccagttggtagaagca

SEQ ID NO: 886 - DNA, 20 bp, Artificial sequence
  Synthetic oligonucleotide
atggaatagcccccaagttc

SEQ ID NO: 887 - DNA, 20 bp, Artificial sequence
  Synthetic oligonucleotide
aagtcttgattttttttttt

SEQ ID NO: 888 - DNA, 20 bp, Artificial sequence
  Synthetic oligonucleotide
ttatctacaaagtaaaagtt

SEQ ID NO: 889 - DNA, 20 bp, Artificial sequence
  Synthetic oligonucleotide
gagatagatccaactgagtc

SEQ ID NO: 890 - DNA, 20 bp, Artificial sequence
  Synthetic oligonucleotide
ccgcctcggacacgaacgca

SEQ ID NO: 891 - DNA, 20 bp, Artificial sequence
  Synthetic oligonucleotide
actgtttcgacctcgatgtt

SEQ ID NO: 892 - DNA, 20 bp, Artificial sequence
  Synthetic oligonucleotide
atgaacccaggagacagaga

SEQ ID NO: 893 - DNA, 20 bp, Artificial sequence
  Synthetic oligonucleotide
aaaaagtttattttctccac

SEQ ID NO: 894 - DNA, 20 bp, Artificial sequence
  Synthetic oligonucleotide
ggtttcatgccattctcttg

SEQ ID NO: 895 - DNA, 20 bp, Artificial sequence
  Synthetic oligonucleotide
taattaaagcactttgggaa

SEQ ID NO: 896 - DNA, 20 bp, Artificial sequence
  Synthetic oligonucleotide
attcttggcagctgggtgca

SEQ ID NO: 897 - DNA, 20 bp, Artificial sequence
  Synthetic oligonucleotide
atgatggcacacacatgtgg

SEQ ID NO: 898 - DNA, 20 bp, Artificial sequence
  Synthetic oligonucleotide
ctccgaaaaattaaaaataa

SEQ ID NO: 899 - DNA, 20 bp, Artificial sequence
  Synthetic oligonucleotide
ttattcactactgtattccc

SEQ ID NO: 900 - DNA, 20 bp, Artificial sequence
  Synthetic oligonucleotide
ccagactttgcagcctacca

SEQ ID NO: 901 - DNA, 20 bp, Artificial sequence
  Synthetic oligonucleotide
ttcccatcttctcgagttct

SEQ ID NO: 902 - DNA, 20 bp, Artificial sequence
  Synthetic oligonucleotide
tcagacttcttgttgttgtt

SEQ ID NO: 903 - DNA, 20 bp, Artificial sequence
  Synthetic oligonucleotide
gagatagcatgccactgcac

SEQ ID NO: 904 - DNA, 20 bp, Artificial sequence
  Synthetic oligonucleotide
aacagcccaatcagaacaag

SEQ ID NO: 905 - DNA, 20 bp, Artificial sequence
  Synthetic oligonucleotide
aataactttatagtgaagaa

SEQ ID NO: 906 - DNA, 20 bp, Artificial sequence
  Synthetic oligonucleotide
aaaaactcacaatctcttcc

SEQ ID NO: 907 - DNA, 20 bp, Artificial sequence
  Synthetic oligonucleotide
atgatctggtatcctggtgg

SEQ ID NO: 908 - DNA, 20 bp, Artificial sequence
  Synthetic oligonucleotide
cttcccatatttctccccca

SEQ ID NO: 909 - DNA, 20 bp, Artificial sequence
  Synthetic oligonucleotide
ttccatcatgtgggacttat

SEQ ID NO: 910 - DNA, 20 bp, Artificial sequence
  Synthetic oligonucleotide
cctcatcaggcttcattcaa

SEQ ID NO: 911 - DNA, 20 bp, Artificial sequence
  Synthetic oligonucleotide
atcaactccaaaggtagcag

SEQ ID NO: 912 - DNA, 20 bp, Artificial sequence
  Synthetic oligonucleotide
aacaaacaaacattaattcg

SEQ ID NO: 913 - DNA, 20 bp, Artificial sequence
  Synthetic oligonucleotide
agtcaagggcatgattgaag

SEQ ID NO: 914 - DNA, 20 bp, Artificial sequence
  Synthetic oligonucleotide
cagaataaaacaatctgtag

SEQ ID NO: 915 - DNA, 20 bp, Artificial sequence
  Synthetic oligonucleotide
taaatctttaatctctttat

SEQ ID NO: 916 - DNA, 20 bp, Artificial sequence
  Synthetic oligonucleotide
tgtacccagccagtaatttt

SEQ ID NO: 917 - DNA, 20 bp, Artificial sequence
  Synthetic oligonucleotide
aaatcagcctgtgcaacagt

SEQ ID NO: 918 - DNA, 20 bp, Artificial sequence
  Synthetic oligonucleotide
ccctagggataccaaaatcc

SEQ ID NO: 919 - DNA, 20 bp, Artificial sequence
  Synthetic oligonucleotide
accaagggcacaggtggagc

SEQ ID NO: 920 - DNA, 20 bp, Artificial sequence
  Synthetic oligonucleotide
gctggtggtcataaagaaat

SEQ ID NO: 921 - DNA, 20 bp, Artificial sequence
  Synthetic oligonucleotide
tttcaagaatgtaaaatgtt

SEQ ID NO: 922 - DNA, 20 bp, Artificial sequence
  Synthetic oligonucleotide
acataattcattaaattata

SEQ ID NO: 923 - DNA, 20 bp, Artificial sequence
  Synthetic oligonucleotide
accaatagtgtaaaagaagt

SEQ ID NO: 924 - DNA, 20 bp, Artificial sequence
  Synthetic oligonucleotide
ctgtaaaagccacctttcag

SEQ ID NO: 925 - DNA, 20 bp, Artificial sequence
  Synthetic oligonucleotide
caagctcttcaagatcttgg

SEQ ID NO: 926 - DNA, 20 bp, Artificial sequence
  Synthetic oligonucleotide
taagttacctcagatccttt

SEQ ID NO: 927 - DNA, 20 bp, Artificial sequence
  Synthetic oligonucleotide
ccaaagggttaattaggatc

SEQ ID NO: 928 - DNA, 20 bp, Artificial sequence
  Synthetic oligonucleotide
tagccaccatgcctggcttc

SEQ ID NO: 929 - DNA, 20 bp, Artificial sequence
  Synthetic oligonucleotide
caattacatgaatgtgcatc

SEQ ID NO: 930 - DNA, 20 bp, Artificial sequence
  Synthetic oligonucleotide
atggtggtttcaaatgtcag

SEQ ID NO: 931 - DNA, 20 bp, Artificial sequence
  Synthetic oligonucleotide
tatatatgtaaattatatct

SEQ ID NO: 932 - DNA, 20 bp, Artificial sequence
  Synthetic oligonucleotide
ttgaaccccaccttatgcta

SEQ ID NO: 933 - DNA, 20 bp, Artificial sequence
  Synthetic oligonucleotide
gggctatgagcatgtcatga

SEQ ID NO: 934 - DNA, 20 bp, Artificial sequence
  Synthetic oligonucleotide
acaaaagaaagaaaacagga

SEQ ID NO: 935 - DNA, 20 bp, Artificial sequence
  Synthetic oligonucleotide
tataatgacaactttaaaac

SEQ ID NO: 936 - DNA, 20 bp, Artificial sequence
  Synthetic oligonucleotide
tacaaaacaaccagataata

SEQ ID NO: 937 - DNA, 20 bp, Artificial sequence
  Synthetic oligonucleotide
ctaggccatagctcccagat

SEQ ID NO: 938 - DNA, 20 bp, Artificial sequence
  Synthetic oligonucleotide
agtttaggaaaggtgttggg

SEQ ID NO: 939 - DNA, 20 bp, Artificial sequence
  Synthetic oligonucleotide
caatttaaaaaaaattgcta

SEQ ID NO: 940 - DNA, 20 bp, Artificial sequence
  Synthetic oligonucleotide
acattaggcacctatgataa

SEQ ID NO: 941 - DNA, 20 bp, Artificial sequence
  Synthetic oligonucleotide
ttgagactcactctttcact

SEQ ID NO: 942 - DNA, 20 bp, Artificial sequence
  Synthetic oligonucleotide
ggcaaggatgcagaacacat

SEQ ID NO: 943 - DNA, 20 bp, Artificial sequence
  Synthetic oligonucleotide
agccaagatatattttaaag

SEQ ID NO: 944 - DNA, 20 bp, Artificial sequence
  Synthetic oligonucleotide
cttcatatatggtacttcat

SEQ ID NO: 945 - DNA, 20 bp, Artificial sequence
  Synthetic oligonucleotide
tttcctctgaacctcttaca

SEQ ID NO: 946 - DNA, 20 bp, Artificial sequence
  Synthetic oligonucleotide
ttaaaacttttattcttcaa

SEQ ID NO: 947 - DNA, 20 bp, Artificial sequence
  Synthetic oligonucleotide
tattacaatatatttaatat

SEQ ID NO: 948 - DNA, 20 bp, Artificial sequence
  Synthetic oligonucleotide
tttataccaagcttgtggct

SEQ ID NO: 949 - DNA, 20 bp, Artificial sequence
  Synthetic oligonucleotide
ctgaagcaaattaagtacag

SEQ ID NO: 950 - DNA, 20 bp, Artificial sequence
  Synthetic oligonucleotide
catactcattaagtttactt

SEQ ID NO: 951 - DNA, 20 bp, Artificial sequence
  Synthetic oligonucleotide
tctacatatgatattaaaat

SEQ ID NO: 952 - DNA, 20 bp, Artificial sequence
  Synthetic oligonucleotide
actcatgtgagtaacaatca

SEQ ID NO: 953 - DNA, 20 bp, Artificial sequence
  Synthetic oligonucleotide
taacccttgacatttctgat

SEQ ID NO: 954 - DNA, 20 bp, Artificial sequence
  Synthetic oligonucleotide
tgttgtatggtaatttggga

SEQ ID NO: 955 - DNA, 20 bp, Artificial sequence
  Synthetic oligonucleotide
gtgcggatagggactcttta

SEQ ID NO: 956 - DNA, 20 bp, Artificial sequence
  Synthetic oligonucleotide
cgccaccgccgccccgcccg

SEQ ID NO: 957 - DNA, 20 bp, Artificial sequence
  Synthetic oligonucleotide
cttcacatttggagccaaca

SEQ ID NO: 958 - DNA, 20 bp, Artificial sequence
  Synthetic oligonucleotide
ggtttgcccttgcttcccgt

SEQ ID NO: 959 - DNA, 20 bp, Artificial sequence
  Synthetic oligonucleotide
gacttctctatttctttgtc

SEQ ID NO: 960 - DNA, 20 bp, Artificial sequence
  Synthetic oligonucleotide
ggtaacagctctgttcgatg

SEQ ID NO: 961 - DNA, 20 bp, Artificial sequence
  Synthetic oligonucleotide
ccgtgttactaagtattgaa

SEQ ID NO: 962 - DNA, 20 bp, Artificial sequence
  Synthetic oligonucleotide
tctgtgcttccagttggtag

SEQ ID NO: 963 - DNA, 20 bp, Artificial sequence
  Synthetic oligonucleotide
cagcatatggaattatggaa

SEQ ID NO: 964 - DNA, 20 bp, Artificial sequence
  Synthetic oligonucleotide
gttccaagtcttgatttttt

SEQ ID NO: 965 - DNA, 20 bp, Artificial sequence
  Synthetic oligonucleotide
ttatattatctacaaagtaa

SEQ ID NO: 966 - DNA, 20 bp, Artificial sequence
  Synthetic oligonucleotide
tctgagagatagatccaact

SEQ ID NO: 967 - DNA, 20 bp, Artificial sequence
  Synthetic oligonucleotide
cgccgccgcctcggacacga

SEQ ID NO: 968 - DNA, 20 bp, Artificial sequence
  Synthetic oligonucleotide
ggacggcggcgcgggccgcg

SEQ ID NO: 969 - DNA, 20 bp, Artificial sequence
  Synthetic oligonucleotide
ttaaatgaacccaggagaca

SEQ ID NO: 970 - DNA, 20 bp, Artificial sequence
  Synthetic oligonucleotide
gcccaaacttaaaaagttta

SEQ ID NO: 971 - DNA, 20 bp, Artificial sequence
  Synthetic oligonucleotide
gctctgcctcccgggtttca

SEQ ID NO: 972 - DNA, 20 bp, Artificial sequence
  Synthetic oligonucleotide
catgactttaaaaagcaata

SEQ ID NO: 973 - DNA, 20 bp, Artificial sequence
  Synthetic oligonucleotide
tttgaattacaatgcggtat

SEQ ID NO: 974 - DNA, 20 bp, Artificial sequence
  Synthetic oligonucleotide
caaggcaagaggagtacttg

SEQ ID NO: 975 - DNA, 20 bp, Artificial sequence
  Synthetic oligonucleotide
gagcaagatcctatctccga

SEQ ID NO: 976 - DNA, 20 bp, Artificial sequence
  Synthetic oligonucleotide
tgttttcctcttcatctaaa

SEQ ID NO: 977 - DNA, 20 bp, Artificial sequence
  Synthetic oligonucleotide
agtcttgttcagtgtccttc

SEQ ID NO: 978 - DNA, 20 bp, Artificial sequence
  Synthetic oligonucleotide
gaaatatttaaattttaatc

SEQ ID NO: 979 - DNA, 20 bp, Artificial sequence
  Synthetic oligonucleotide
ttgttcttccaatttcagac

SEQ ID NO: 980 - DNA, 20 bp, Artificial sequence
  Synthetic oligonucleotide
aaaattacttctcattgaca

SEQ ID NO: 981 - DNA, 20 bp, Artificial sequence
  Synthetic oligonucleotide
gaatcatgcctcatatgata

SEQ ID NO: 982 - DNA, 20 bp, Artificial sequence
  Synthetic oligonucleotide
tccacagaagctaaatatag

SEQ ID NO: 983 - DNA, 20 bp, Artificial sequence
  Synthetic oligonucleotide
aaattgttaaaatggtatat

SEQ ID NO: 984 - DNA, 20 bp, Artificial sequence
  Synthetic oligonucleotide
aacgatgatctggtatcctg

SEQ ID NO: 985 - DNA, 20 bp, Artificial sequence
  Synthetic oligonucleotide
cttgatttaaccaacacaga

SEQ ID NO: 986 - DNA, 20 bp, Artificial sequence
  Synthetic oligonucleotide
aaaatttgtgatagcttctc

SEQ ID NO: 987 - DNA, 20 bp, Artificial sequence
  Synthetic oligonucleotide
ttggagccctaaaaacatat

SEQ ID NO: 988 - DNA, 20 bp, Artificial sequence
  Synthetic oligonucleotide
aatatttcaatagtataagt

SEQ ID NO: 989 - DNA, 20 bp, Artificial sequence
  Synthetic oligonucleotide
cacgccactgtacccagcct

SEQ ID NO: 990 - DNA, 20 bp, Artificial sequence
  Synthetic oligonucleotide
gaaaaagagaacaaggaggt

SEQ ID NO: 991 - DNA, 20 bp, Artificial sequence
  Synthetic oligonucleotide
gaagagatccctgtttgtta

SEQ ID NO: 992 - DNA, 20 bp, Artificial sequence
  Synthetic oligonucleotide
ccaccttttcatacattcac

SEQ ID NO: 993 - DNA, 20 bp, Artificial sequence
  Synthetic oligonucleotide
taccaccgtgtctggctact

SEQ ID NO: 994 - DNA, 20 bp, Artificial sequence
  Synthetic oligonucleotide
tgatacagccactatgccca

SEQ ID NO: 995 - DNA, 20 bp, Artificial sequence
  Synthetic oligonucleotide
aataaattattccaacacac

SEQ ID NO: 996 - DNA, 20 bp, Artificial sequence
  Synthetic oligonucleotide
atattaaagactataatact

SEQ ID NO: 997 - DNA, 20 bp, Artificial sequence
  Synthetic oligonucleotide
tgccacctgctggtggtcat

SEQ ID NO: 998 - DNA, 20 bp, Artificial sequence
  Synthetic oligonucleotide
taaagttatgtggattgctg

SEQ ID NO: 999 - DNA, 20 bp, Artificial sequence
  Synthetic oligonucleotide
cagatgactatcagtaaagg

SEQ ID NO: 1000 - DNA, 20 bp, Artificial sequence
  Synthetic oligonucleotide
ctatcaatttatccacctca

SEQ ID NO: 1001 - DNA, 20 bp, Artificial sequence
  Synthetic oligonucleotide
cataaaatagccttcagatc

SEQ ID NO: 1002 - DNA, 20 bp, Artificial sequence
  Synthetic oligonucleotide
ctagctcctcctcattctgt

SEQ ID NO: 1003 - DNA, 20 bp, Artificial sequence
  Synthetic oligonucleotide
ccttagactaagggttgttt

SEQ ID NO: 1004 - DNA, 20 bp, Artificial sequence
  Synthetic oligonucleotide
tcccaaagggttaattagga

SEQ ID NO: 1005 - DNA, 20 bp, Artificial sequence
  Synthetic oligonucleotide
tcctcactctctcacccggc

SEQ ID NO: 1006 - DNA, 20 bp, Artificial sequence
  Synthetic oligonucleotide
cctcccgggtcctggttcaa

SEQ ID NO: 1007 - DNA, 20 bp, Artificial sequence
  Synthetic oligonucleotide
gctatggtggtttcaaatgt

SEQ ID NO: 1008 - DNA, 20 bp, Artificial sequence
  Synthetic oligonucleotide
ttatatatgtaaattatatc

SEQ ID NO: 1009 - DNA, 20 bp, Artificial sequence
  Synthetic oligonucleotide
gtcaattagaaataaaaaat

SEQ ID NO: 1010 - DNA, 20 bp, Artificial sequence
  Synthetic oligonucleotide
ctaaaacccacattattaac

SEQ ID NO: 1011 - DNA, 20 bp, Artificial sequence
  Synthetic oligonucleotide
catcctctacaaaagaaaga

SEQ ID NO: 1012 - DNA, 20 bp, Artificial sequence
  Synthetic oligonucleotide
tacaaaaatcaacacacaaa

SEQ ID NO: 1013 - DNA, 20 bp, Artificial sequence
  Synthetic oligonucleotide
aaaatcactttcaaaacaag

SEQ ID NO: 1014 - DNA, 20 bp, Artificial sequence
  Synthetic oligonucleotide
tggatactagttcagccaca

SEQ ID NO: 1015 - DNA, 20 bp, Artificial sequence
  Synthetic oligonucleotide
tcagacacttcacaataaaa

SEQ ID NO: 1016 - DNA, 20 bp, Artificial sequence
  Synthetic oligonucleotide
aaacctacctgagagaagga

SEQ ID NO: 1017 - DNA, 20 bp, Artificial sequence
  Synthetic oligonucleotide
aaaaattaacattaggcacc

SEQ ID NO: 1018 - DNA, 20 bp, Artificial sequence
  Synthetic oligonucleotide
gtttggcagttccatcacag

SEQ ID NO: 1019 - DNA, 20 bp, Artificial sequence
  Synthetic oligonucleotide
ttactaaaaaaaggttgaca

SEQ ID NO: 1020 - DNA, 20 bp, Artificial sequence
  Synthetic oligonucleotide
ttattgtaaaaagatttatc

SEQ ID NO: 1021 - DNA, 20 bp, Artificial sequence
  Synthetic oligonucleotide
taaaaactaacatataaaca

SEQ ID NO: 1022 - DNA, 20 bp, Artificial sequence
  Synthetic oligonucleotide
gtaaactctcaaatctttct

SEQ ID NO: 1023 - DNA, 20 bp, Artificial sequence
  Synthetic oligonucleotide
gcataagctgtgggttacag

SEQ ID NO: 1024 - DNA, 20 bp, Artificial sequence
  Synthetic oligonucleotide
gtatttggttcctttgagaa

SEQ ID NO: 1025 - DNA, 20 bp, Artificial sequence
  Synthetic oligonucleotide
cttagtatttcatcaatcct

SEQ ID NO: 1026 - DNA, 20 bp, Artificial sequence
  Synthetic oligonucleotide
agtgttccttgacataaata

SEQ ID NO: 1027 - DNA, 20 bp, Artificial sequence
  Synthetic oligonucleotide
acaggccctccatcatcatc

SEQ ID NO: 1028 - DNA, 20 bp, Artificial sequence
  Synthetic oligonucleotide
ctctacatatgatattaaaa

SEQ ID NO: 1029 - DNA, 20 bp, Artificial sequence
  Synthetic oligonucleotide
agcagatatatggataacca

SEQ ID NO: 1030 - DNA, 20 bp, Artificial sequence
  Synthetic oligonucleotide
catgtcaactgtgttccttt

SEQ ID NO: 1031 - DNA, 20 bp, Artificial sequence
  Synthetic oligonucleotide
tcaagtttagtaaaagggcg

SEQ ID NO: 1032 - DNA, 20 bp, Artificial sequence
  Synthetic oligonucleotide
cggaggtgcggatagggact

SEQ ID NO: 1033 - DNA, 20 bp, Artificial sequence
  Synthetic oligonucleotide
ggccgcgccaccgccgcccc

SEQ ID NO: 1034 - DNA, 20 bp, Artificial sequence
  Synthetic oligonucleotide
tacttcacatttggagccaa

SEQ ID NO: 1035 - DNA, 20 bp, Artificial sequence
  Synthetic oligonucleotide
tggtttgcccttgcttcccg

SEQ ID NO: 1036 - DNA, 20 bp, Artificial sequence
  Synthetic oligonucleotide
atgacttctctatttctttg

SEQ ID NO: 1037 - DNA, 20 bp, Artificial sequence
  Synthetic oligonucleotide
ctttagcctcactagaaggg

SEQ ID NO: 1038 - DNA, 20 bp, Artificial sequence
  Synthetic oligonucleotide
tccgtgttactaagtattga

SEQ ID NO: 1039 - DNA, 20 bp, Artificial sequence
  Synthetic oligonucleotide
cttgttgtatggtaatttgg

SEQ ID NO: 1040 - DNA, 20 bp, Artificial sequence
  Synthetic oligonucleotide
tgaaattctagttttctgtg

SEQ ID NO: 1041 - DNA, 20 bp, Artificial sequence
  Synthetic oligonucleotide
tgaaacagcatatggaatta

SEQ ID NO: 1042 - DNA, 20 bp, Artificial sequence
  Synthetic oligonucleotide
ttattttatattatctacaa

SEQ ID NO: 1043 - DNA, 20 bp, Artificial sequence
  Synthetic oligonucleotide
agccttctgagagatagatc

SEQ ID NO: 1044 - DNA, 20 bp, Artificial sequence
  Synthetic oligonucleotide
gcccccgccgccgcctcgga

SEQ ID NO: 1045 - DNA, 20 bp, Artificial sequence
  Synthetic oligonucleotide
ctgccggcccccagcccacc

SEQ ID NO: 1046 - DNA, 20 bp, Artificial sequence
  Synthetic oligonucleotide
tggcaaaatcccgtcctcac

SEQ ID NO: 1047 - DNA, 20 bp, Artificial sequence
  Synthetic oligonucleotide
cactgtttcagaatgtggaa

SEQ ID NO: 1048 - DNA, 20 bp, Artificial sequence
  Synthetic oligonucleotide
gcatatagcaagagatgtag

SEQ ID NO: 1049 - DNA, 20 bp, Artificial sequence
  Synthetic oligonucleotide
attattaagaatattttaac

SEQ ID NO: 1050 - DNA, 20 bp, Artificial sequence
  Synthetic oligonucleotide
gcagagcaggactagtccat

SEQ ID NO: 1051 - DNA, 20 bp, Artificial sequence
  Synthetic oligonucleotide
gccttaatttcaatactttg

SEQ ID NO: 1052 - DNA, 20 bp, Artificial sequence
  Synthetic oligonucleotide
gcaagagtttcacttgagcc

SEQ ID NO: 1053 - DNA, 20 bp, Artificial sequence
  Synthetic oligonucleotide
cccatttcagcctccccatg

SEQ ID NO: 1054 - DNA, 20 bp, Artificial sequence
  Synthetic oligonucleotide
tactgctgaagtcttgttca

SEQ ID NO: 1055 - DNA, 20 bp, Artificial sequence
  Synthetic oligonucleotide
acttgaaatacgattagtat

SEQ ID NO: 1056 - DNA, 20 bp, Artificial sequence
  Synthetic oligonucleotide
ctcacttaggtgagtcattt

SEQ ID NO: 1057 - DNA, 20 bp, Artificial sequence
  Synthetic oligonucleotide
tgagatataacaatattgaa

SEQ ID NO: 1058 - DNA, 20 bp, Artificial sequence
  Synthetic oligonucleotide
aggaatcatgcctcatatga

SEQ ID NO: 1059 - DNA, 20 bp, Artificial sequence
  Synthetic oligonucleotide
gcagaaggaccacttaagac

SEQ ID NO: 1060 - DNA, 20 bp, Artificial sequence
  Synthetic oligonucleotide
aatacatataaaagcaatgc

SEQ ID NO: 1061 - DNA, 20 bp, Artificial sequence
  Synthetic oligonucleotide
tacctcgcctaacaaaaatt

SEQ ID NO: 1062 - DNA, 20 bp, Artificial sequence
  Synthetic oligonucleotide
accagagtccaggagtctga

SEQ ID NO: 1063 - DNA, 20 bp, Artificial sequence
  Synthetic oligonucleotide
agtctcaaaaatttgtgata

SEQ ID NO: 1064 - DNA, 20 bp, Artificial sequence
  Synthetic oligonucleotide
atcattcaaagtggctttaa

SEQ ID NO: 1065 - DNA, 20 bp, Artificial sequence
  Synthetic oligonucleotide
ttataacagaggaatatttc

SEQ ID NO: 1066 - DNA, 20 bp, Artificial sequence
  Synthetic oligonucleotide
atcctttaacaaccatggaa

SEQ ID NO: 1067 - DNA, 20 bp, Artificial sequence
  Synthetic oligonucleotide
ggtataaaagagcaaggaga

SEQ ID NO: 1068 - DNA, 20 bp, Artificial sequence
  Synthetic oligonucleotide
ccgtaaacagcttttctaat

SEQ ID NO: 1069 - DNA, 20 bp, Artificial sequence
  Synthetic oligonucleotide
acaagtgaggagggccacct

SEQ ID NO: 1070 - DNA, 20 bp, Artificial sequence
  Synthetic oligonucleotide
atctccctgcgctcagatga

SEQ ID NO: 1071 - DNA, 20 bp, Artificial sequence
  Synthetic oligonucleotide
taggattgtaaaatgataca

SEQ ID NO: 1072 - DNA, 20 bp, Artificial sequence
  Synthetic oligonucleotide
atggaacagaacttaggagg

SEQ ID NO: 1073 - DNA, 20 bp, Artificial sequence
  Synthetic oligonucleotide
atgtattatacagattatat

SEQ ID NO: 1074 - DNA, 20 bp, Artificial sequence
  Synthetic oligonucleotide
gggcagaaacttagtcattt

SEQ ID NO: 1075 - DNA, 20 bp, Artificial sequence
  Synthetic oligonucleotide
tcttaccaacacctcatctt

SEQ ID NO: 1076 - DNA, 20 bp, Artificial sequence
  Synthetic oligonucleotide
ttaatttagcaaatggaatc

SEQ ID NO: 1077 - DNA, 20 bp, Artificial sequence
  Synthetic oligonucleotide
aaattttgattagcattgcc

SEQ ID NO: 1078 - DNA, 20 bp, Artificial sequence
  Synthetic oligonucleotide
gttataaccaacatctatat

SEQ ID NO: 1079 - DNA, 20 bp, Artificial sequence
  Synthetic oligonucleotide
ctattatcttatcacaaaat

SEQ ID NO: 1080 - DNA, 20 bp, Artificial sequence
  Synthetic oligonucleotide
gttgctaaactgtaacatcc

SEQ ID NO: 1081 - DNA, 20 bp, Artificial sequence
  Synthetic oligonucleotide
ttcccaaagggttaattagg

SEQ ID NO: 1082 - DNA, 20 bp, Artificial sequence
  Synthetic oligonucleotide
gcctactggtgttaacacca

SEQ ID NO: 1083 - DNA, 20 bp, Artificial sequence
  Synthetic oligonucleotide
aatggagtctcactctatag

SEQ ID NO: 1084 - DNA, 20 bp, Artificial sequence
  Synthetic oligonucleotide
taagctgtgctatggtggtt

SEQ ID NO: 1085 - DNA, 20 bp, Artificial sequence
  Synthetic oligonucleotide
atttatatatgtaaattata

SEQ ID NO: 1086 - DNA, 20 bp, Artificial sequence
  Synthetic oligonucleotide
acttacacagtaaaaatggt

SEQ ID NO: 1087 - DNA, 20 bp, Artificial sequence
  Synthetic oligonucleotide
acactatgaagcaggttcta

SEQ ID NO: 1088 - DNA, 20 bp, Artificial sequence
  Synthetic oligonucleotide
taagtgatgaggtttttaag

SEQ ID NO: 1089 - DNA, 20 bp, Artificial sequence
  Synthetic oligonucleotide
acctattagaactgacaaac

SEQ ID NO: 1090 - DNA, 20 bp, Artificial sequence
  Synthetic oligonucleotide
gggttataaaatgttatttg

SEQ ID NO: 1091 - DNA, 20 bp, Artificial sequence
  Synthetic oligonucleotide
gcaatgtggatactagttca

SEQ ID NO: 1092 - DNA, 20 bp, Artificial sequence
  Synthetic oligonucleotide
tcctcttatacttgtcattt

SEQ ID NO: 1093 - DNA, 20 bp, Artificial sequence
  Synthetic oligonucleotide
aggactattactaataattt

SEQ ID NO: 1094 - DNA, 20 bp, Artificial sequence
  Synthetic oligonucleotide
cacaccaggcctccaattac

SEQ ID NO: 1095 - DNA, 20 bp, Artificial sequence
  Synthetic oligonucleotide
gggcacgatctcaaaacaat

SEQ ID NO: 1096 - DNA, 20 bp, Artificial sequence
  Synthetic oligonucleotide
tgcaaagacagggttttgtc

SEQ ID NO: 1097 - DNA, 20 bp, Artificial sequence
  Synthetic oligonucleotide
aaacaaatccaaattgcaag

SEQ ID NO: 1098 - DNA, 20 bp, Artificial sequence
  Synthetic oligonucleotide
tacaaaaatattagccagct

SEQ ID NO: 1099 - DNA, 20 bp, Artificial sequence
  Synthetic oligonucleotide
aaacagctgtaaactctcaa

SEQ ID NO: 1100 - DNA, 20 bp, Artificial sequence
  Synthetic oligonucleotide
aaactaaacacctttgatca

SEQ ID NO: 1101 - DNA, 20 bp, Artificial sequence
  Synthetic oligonucleotide
aaaaggtgacataaaattgt

SEQ ID NO: 1102 - DNA, 20 bp, Artificial sequence
  Synthetic oligonucleotide
agccatgcacaggactgaaa

SEQ ID NO: 1103 - DNA, 20 bp, Artificial sequence
  Synthetic oligonucleotide
ctttggtccagacctagtcc

SEQ ID NO: 1104 - DNA, 20 bp, Artificial sequence
  Synthetic oligonucleotide
aagacagtcctttttttcta

SEQ ID NO: 1105 - DNA, 20 bp, Artificial sequence
  Synthetic oligonucleotide
taatacagctctacatatga

SEQ ID NO: 1106 - DNA, 20 bp, Artificial sequence
  Synthetic oligonucleotide
aaagcagatatatggataac

SEQ ID NO: 1107 - DNA, 20 bp, Artificial sequence
  Synthetic oligonucleotide
acaggcaacatctccggctt

SEQ ID NO: 1108 - DNA, 20 bp, Artificial sequence
  Synthetic oligonucleotide
gggagcggaggtgcggatag

SEQ ID NO: 1109 - DNA, 20 bp, Artificial sequence
  Synthetic oligonucleotide
gcggagggatacggtcccgg

SEQ ID NO: 1110 - DNA, 20 bp, Artificial sequence
  Synthetic oligonucleotide
gtacttcacatttggagcca

SEQ ID NO: 1111 - DNA, 20 bp, Artificial sequence
  Synthetic oligonucleotide
actggtttgcccttgcttcc

SEQ ID NO: 1112 - DNA, 20 bp, Artificial sequence
  Synthetic oligonucleotide
atatgacttctctatttctt

SEQ ID NO: 1113 - DNA, 20 bp, Artificial sequence
  Synthetic oligonucleotide
gatgtttcattgggtttaat

SEQ ID NO: 1114 - DNA, 20 bp, Artificial sequence
  Synthetic oligonucleotide
ctccgtgttactaagtattg

SEQ ID NO: 1115 - DNA, 20 bp, Artificial sequence
  Synthetic oligonucleotide
ccttgttgtatggtaatttg

SEQ ID NO: 1116 - DNA, 20 bp, Artificial sequence
  Synthetic oligonucleotide
ataaatgaaattctagtttt

SEQ ID NO: 1117 - DNA, 20 bp, Artificial sequence
  Synthetic oligonucleotide
gactctgaaacagcatatgg

SEQ ID NO: 1118 - DNA, 20 bp, Artificial sequence
  Synthetic oligonucleotide
ctttgtcaagtttagtaaaa

SEQ ID NO: 1119 - DNA, 20 bp, Artificial sequence
  Synthetic oligonucleotide
agtttttattttatattatc

SEQ ID NO: 1120 - DNA, 20 bp, Artificial sequence
  Synthetic oligonucleotide
aaggtagccttctgagagat

SEQ ID NO: 1121 - DNA, 20 bp, Artificial sequence
  Synthetic oligonucleotide
cgggagcccccgccgccgcc

SEQ ID NO: 1122 - DNA, 20 bp, Artificial sequence
  Synthetic oligonucleotide
gtctcccccgcgctgccggc

SEQ ID NO: 1123 - DNA, 20 bp, Artificial sequence
  Synthetic oligonucleotide
acatggcaaaatcccgtcct

SEQ ID NO: 1124 - DNA, 20 bp, Artificial sequence
  Synthetic oligonucleotide
accatgactgatcccatgtt

SEQ ID NO: 1125 - DNA, 20 bp, Artificial sequence
  Synthetic oligonucleotide
ctgcatatagcaagagatgt

SEQ ID NO: 1126 - DNA, 20 bp, Artificial sequence
  Synthetic oligonucleotide
aattataatcaagattaatt

SEQ ID NO: 1127 - DNA, 20 bp, Artificial sequence
  Synthetic oligonucleotide
aaaaattcattgaactgttg

SEQ ID NO: 1128 - DNA, 20 bp, Artificial sequence
  Synthetic oligonucleotide
ctactatgtgccaagaacag

SEQ ID NO: 1129 - DNA, 20 bp, Artificial sequence
  Synthetic oligonucleotide
gcctgtaatccctcccaaca

SEQ ID NO: 1130 - DNA, 20 bp, Artificial sequence
  Synthetic oligonucleotide
tgtttccctccctttttaat

SEQ ID NO: 1131 - DNA, 20 bp, Artificial sequence
  Synthetic oligonucleotide
aacagcaaaaggtaggctag

SEQ ID NO: 1132 - DNA, 20 bp, Artificial sequence
  Synthetic oligonucleotide
tatgtcatgctgtccaatat

SEQ ID NO: 1133 - DNA, 20 bp, Artificial sequence
  Synthetic oligonucleotide
taaggttaactcacttaggt

SEQ ID NO: 1134 - DNA, 20 bp, Artificial sequence
  Synthetic oligonucleotide
tgcctctctattccctgaga

SEQ ID NO: 1135 - DNA, 20 bp, Artificial sequence
  Synthetic oligonucleotide
aaggcacattgtgtggccaa

SEQ ID NO: 1136 - DNA, 20 bp, Artificial sequence
  Synthetic oligonucleotide
cccggcctcgagactccacc

SEQ ID NO: 1137 - DNA, 20 bp, Artificial sequence
  Synthetic oligonucleotide
taggaggagaacttatgaat

SEQ ID NO: 1138 - DNA, 20 bp, Artificial sequence
  Synthetic oligonucleotide
agctggtatttaaaccaggt

SEQ ID NO: 1139 - DNA, 20 bp, Artificial sequence
  Synthetic oligonucleotide
tgaggcaggatcaccagagt

SEQ ID NO: 1140 - DNA, 20 bp, Artificial sequence
  Synthetic oligonucleotide
caaccacactactccatatt

SEQ ID NO: 1141 - DNA, 20 bp, Artificial sequence
  Synthetic oligonucleotide
taaaataatcagtatttgaa

SEQ ID NO: 1142 - DNA, 20 bp, Artificial sequence
  Synthetic oligonucleotide
atttttgaatttataacaga

SEQ ID NO: 1143 - DNA, 20 bp, Artificial sequence
  Synthetic oligonucleotide
aggtttccctggctgggcgc

SEQ ID NO: 1144 - DNA, 20 bp, Artificial sequence
  Synthetic oligonucleotide
ggacctggcagttagaggtt

SEQ ID NO: 1145 - DNA, 20 bp, Artificial sequence
  Synthetic oligonucleotide
ctggcctcaataagtgccac

SEQ ID NO: 1146 - DNA, 20 bp, Artificial sequence
  Synthetic oligonucleotide
aaatcattacaagtgaggag

SEQ ID NO: 1147 - DNA, 20 bp, Artificial sequence
  Synthetic oligonucleotide
tctcacttggctcactgcag

SEQ ID NO: 1148 - DNA, 20 bp, Artificial sequence
  Synthetic oligonucleotide
tgtaaaatgatacagctacg

SEQ ID NO: 1149 - DNA, 20 bp, Artificial sequence
  Synthetic oligonucleotide
agaagtgtaaagtttatagc

SEQ ID NO: 1150 - DNA, 20 bp, Artificial sequence
  Synthetic oligonucleotide
tatactactacaccatgtat

SEQ ID NO: 1151 - DNA, 20 bp, Artificial sequence
  Synthetic oligonucleotide
tgaattttggaaaatctctc

SEQ ID NO: 1152 - DNA, 20 bp, Artificial sequence
  Synthetic oligonucleotide
agaccaatgcactataataa

SEQ ID NO: 1153 - DNA, 20 bp, Artificial sequence
  Synthetic oligonucleotide
tcattcagttataaccaaca

SEQ ID NO: 1154 - DNA, 20 bp, Artificial sequence
  Synthetic oligonucleotide
ataaactcttctcccaactc

SEQ ID NO: 1155 - DNA, 20 bp, Artificial sequence
  Synthetic oligonucleotide
aaagatccacaacctacaag

SEQ ID NO: 1156 - DNA, 20 bp, Artificial sequence
  Synthetic oligonucleotide
gttcccaaagggttaattag

SEQ ID NO: 1157 - DNA, 20 bp, Artificial sequence
  Synthetic oligonucleotide
ctgccatgccactagtgact

SEQ ID NO: 1158 - DNA, 20 bp, Artificial sequence
  Synthetic oligonucleotide
gaagcagatttttttttttt

SEQ ID NO: 1159 - DNA, 20 bp, Artificial sequence
  Synthetic oligonucleotide
tcactgaacaaagtacaaat

SEQ ID NO: 1160 - DNA, 20 bp, Artificial sequence
  Synthetic oligonucleotide
aaccactgatttatacactt

SEQ ID NO: 1161 - DNA, 20 bp, Artificial sequence
  Synthetic oligonucleotide
tgcctggccaagaatagtct

SEQ ID NO: 1162 - DNA, 20 bp, Artificial sequence
  Synthetic oligonucleotide
gaacatgtattgaatacata

SEQ ID NO: 1163 - DNA, 20 bp, Artificial sequence
  Synthetic oligonucleotide
cagaagacaaagatattagc

SEQ ID NO: 1164 - DNA, 20 bp, Artificial sequence
  Synthetic oligonucleotide
atattatttatactgtgtat

SEQ ID NO: 1165 - DNA, 20 bp, Artificial sequence
  Synthetic oligonucleotide
gttttctctttgcttgcttg

SEQ ID NO: 1166 - DNA, 20 bp, Artificial sequence
  Synthetic oligonucleotide
tcttgcaatgtggatactag

SEQ ID NO: 1167 - DNA, 20 bp, Artificial sequence
  Synthetic oligonucleotide
tttctatcctcttatacttg

SEQ ID NO: 1168 - DNA, 20 bp, Artificial sequence
  Synthetic oligonucleotide
cacactaaaacaaaattcag

SEQ ID NO: 1169 - DNA, 20 bp, Artificial sequence
  Synthetic oligonucleotide
gctctcgaactcatgggttc

SEQ ID NO: 1170 - DNA, 20 bp, Artificial sequence
  Synthetic oligonucleotide
agcctgggaagcacggagaa

SEQ ID NO: 1171 - DNA, 20 bp, Artificial sequence
  Synthetic oligonucleotide
atcacccctccatcgccctc

SEQ ID NO: 1172 - DNA, 20 bp, Artificial sequence
  Synthetic oligonucleotide
taggtgacagagccaagatt

SEQ ID NO: 1173 - DNA, 20 bp, Artificial sequence
  Synthetic oligonucleotide
tgttacttattaccttcctg

SEQ ID NO: 1174 - DNA, 20 bp, Artificial sequence
  Synthetic oligonucleotide
tggtttccagatttccagaa

SEQ ID NO: 1175 - DNA, 20 bp, Artificial sequence
  Synthetic oligonucleotide
cacaattttttatttaaaat

SEQ ID NO: 1176 - DNA, 20 bp, Artificial sequence
  Synthetic oligonucleotide
tgaatgagaaaaggtgacat

SEQ ID NO: 1177 - DNA, 20 bp, Artificial sequence
  Synthetic oligonucleotide
gccagcatgcatggctgatt

SEQ ID NO: 1178 - DNA, 20 bp, Artificial sequence
  Synthetic oligonucleotide
tcaaagacatatgcttcttt

SEQ ID NO: 1179 - DNA, 20 bp, Artificial sequence
  Synthetic oligonucleotide
cttcctgagcttcacagtcc

SEQ ID NO: 1180 - DNA, 20 bp, Artificial sequence
  Synthetic oligonucleotide
atttaaaccatccattgtct

SEQ ID NO: 1181 - DNA, 20 bp, Artificial sequence
  Synthetic oligonucleotide
acaacttatggtcaaagcag

SEQ ID NO: 1182 - DNA, 20 bp, Artificial sequence
  Synthetic oligonucleotide
agagctcttttacgcataca

SEQ ID NO: 1183 - DNA, 20 bp, Artificial sequence
  Synthetic oligonucleotide
ctgagcgcatcggagggcgg

SEQ ID NO: 1184 - DNA, 20 bp, Artificial sequence
  Synthetic oligonucleotide
aggcgagctctgccgggagg

SEQ ID NO: 1185 - DNA, 20 bp, Artificial sequence
  Synthetic oligonucleotide
tgtacttcacatttggagcc

SEQ ID NO: 1186 - DNA, 20 bp, Artificial sequence
  Synthetic oligonucleotide
taactggtttgcccttgctt

SEQ ID NO: 1187 - DNA, 20 bp, Artificial sequence
  Synthetic oligonucleotide
aattcgggttgaaatctgaa

SEQ ID NO: 1188 - DNA, 20 bp, Artificial sequence
  Synthetic oligonucleotide
gtgatgtttcattgggttta

SEQ ID NO: 1189 - DNA, 20 bp, Artificial sequence
  Synthetic oligonucleotide
tgctccgtgttactaagtat

SEQ ID NO: 1190 - DNA, 20 bp, Artificial sequence
  Synthetic oligonucleotide
tccttgttgtatggtaattt

SEQ ID NO: 1191 - DNA, 20 bp, Artificial sequence
  Synthetic oligonucleotide
acaaaataaatgaaattcta

SEQ ID NO: 1192 - DNA, 20 bp, Artificial sequence
  Synthetic oligonucleotide
tgaaactttgtcaagtttag

SEQ ID NO: 1193 - DNA, 20 bp, Artificial sequence
  Synthetic oligonucleotide
ttttaagtttttattttata

SEQ ID NO: 1194 - DNA, 20 bp, Artificial sequence
  Synthetic oligonucleotide
gagttcgggagcccccgccg

SEQ ID NO: 1195 - DNA, 20 bp, Artificial sequence
  Synthetic oligonucleotide
cgagcgagtctcccccgcgc

SEQ ID NO: 1196 - DNA, 20 bp, Artificial sequence
  Synthetic oligonucleotide
aaaagcaaaaataagaatta

SEQ ID NO: 1197 - DNA, 20 bp, Artificial sequence
  Synthetic oligonucleotide
gaacaccatgactgatccca

SEQ ID NO: 1198 - DNA, 20 bp, Artificial sequence
  Synthetic oligonucleotide
tagcacctgagccccacctg

SEQ ID NO: 1199 - DNA, 20 bp, Artificial sequence
  Synthetic oligonucleotide
cttcaattcctgatttcgaa

SEQ ID NO: 1200 - DNA, 20 bp, Artificial sequence
  Synthetic oligonucleotide
aaaaaaaatttttggctagg

SEQ ID NO: 1201 - DNA, 20 bp, Artificial sequence
  Synthetic oligonucleotide
tttcaagtctatcaacagat

SEQ ID NO: 1202 - DNA, 20 bp, Artificial sequence
  Synthetic oligonucleotide
aatgggaagaaagaggaggc

SEQ ID NO: 1203 - DNA, 20 bp, Artificial sequence
  Synthetic oligonucleotide
gaggacaggataacagatta

SEQ ID NO: 1204 - DNA, 20 bp, Artificial sequence
  Synthetic oligonucleotide
gagttgaagtctaacagcaa

SEQ ID NO: 1205 - DNA, 20 bp, Artificial sequence
  Synthetic oligonucleotide
actttgtacaatgatgaaga

SEQ ID NO: 1206 - DNA, 20 bp, Artificial sequence
  Synthetic oligonucleotide
gttccacctcttaaggttaa

SEQ ID NO: 1207 - DNA, 20 bp, Artificial sequence
  Synthetic oligonucleotide
ttatagtaatctgtaatcag

SEQ ID NO: 1208 - DNA, 20 bp, Artificial sequence
  Synthetic oligonucleotide
atagatatagcccccaaagg

SEQ ID NO: 1209 - DNA, 20 bp, Artificial sequence
  Synthetic oligonucleotide
gcaagactccgtctttctgt

SEQ ID NO: 1210 - DNA, 20 bp, Artificial sequence
  Synthetic oligonucleotide
aaacatcataggaggagaac

SEQ ID NO: 1211 - DNA, 20 bp, Artificial sequence
  Synthetic oligonucleotide
ctcagcagtcaagtatcttg

SEQ ID NO: 1212 - DNA, 20 bp, Artificial sequence
  Synthetic oligonucleotide
agaaggaagcaaactagaaa

SEQ ID NO: 1213 - DNA, 20 bp, Artificial sequence
  Synthetic oligonucleotide
caggtcataccttcatagaa

SEQ ID NO: 1214 - DNA, 20 bp, Artificial sequence
  Synthetic oligonucleotide
aaaccagtctataaaataat

SEQ ID NO: 1215 - DNA, 20 bp, Artificial sequence
  Synthetic oligonucleotide
ttcaactaaaattttatctt

SEQ ID NO: 1216 - DNA, 20 bp, Artificial sequence
  Synthetic oligonucleotide
actccgcctcaaaataaagg

SEQ ID NO: 1217 - DNA, 20 bp, Artificial sequence
  Synthetic oligonucleotide
aaaggacctggcagttagag

SEQ ID NO: 1218 - DNA, 20 bp, Artificial sequence
  Synthetic oligonucleotide
taataaacatgtaatgcttt

SEQ ID NO: 1219 - DNA, 20 bp, Artificial sequence
  Synthetic oligonucleotide
tttcttaaatcattacaagt

SEQ ID NO: 1220 - DNA, 20 bp, Artificial sequence
  Synthetic oligonucleotide
gaaaccagggtctcacttgg

SEQ ID NO: 1221 - DNA, 20 bp, Artificial sequence
  Synthetic oligonucleotide
ggtgaggatgtgaaaaacat

SEQ ID NO: 1222 - DNA, 20 bp, Artificial sequence
  Synthetic oligonucleotide
gattaggagtagacagagtt

SEQ ID NO: 1223 - DNA, 20 bp, Artificial sequence
  Synthetic oligonucleotide
tgtataaacattttctgaat

SEQ ID NO: 1224 - DNA, 20 bp, Artificial sequence
  Synthetic oligonucleotide
gctacccccacagcagtggg

SEQ ID NO: 1225 - DNA, 20 bp, Artificial sequence
  Synthetic oligonucleotide
tagaaatggctgaattttgg

SEQ ID NO: 1226 - DNA, 20 bp, Artificial sequence
  Synthetic oligonucleotide
gtcatactgaccagagtcta

SEQ ID NO: 1227 - DNA, 20 bp, Artificial sequence
  Synthetic oligonucleotide
atgtcaaagtagttgttccc

SEQ ID NO: 1228 - DNA, 20 bp, Artificial sequence
  Synthetic oligonucleotide
tgctgcacctgacacagatc

SEQ ID NO: 1229 - DNA, 20 bp, Artificial sequence
  Synthetic oligonucleotide
gaaaagatccacaacctaca

SEQ ID NO: 1230 - DNA, 20 bp, Artificial sequence
  Synthetic oligonucleotide
aattcacattttactttaac

SEQ ID NO: 1231 - DNA, 20 bp, Artificial sequence
  Synthetic oligonucleotide
acagaatagctgaagcagat

SEQ ID NO: 1232 - DNA, 20 bp, Artificial sequence
  Synthetic oligonucleotide
gcttcactgaacaaagtaca

SEQ ID NO: 1233 - DNA, 20 bp, Artificial sequence
  Synthetic oligonucleotide
ttgatttatatatgtaaatt

SEQ ID NO: 1234 - DNA, 20 bp, Artificial sequence
  Synthetic oligonucleotide
gacatgcggtttcaccattt

SEQ ID NO: 1235 - DNA, 20 bp, Artificial sequence
  Synthetic oligonucleotide
aatactgggtcatctatatt

SEQ ID NO: 1236 - DNA, 20 bp, Artificial sequence
  Synthetic oligonucleotide
acctttaaagtagactgcaa

SEQ ID NO: 1237 - DNA, 20 bp, Artificial sequence
  Synthetic oligonucleotide
tatatatattatttatactg

SEQ ID NO: 1238 - DNA, 20 bp, Artificial sequence
  Synthetic oligonucleotide
actacagttttttaagacat

SEQ ID NO: 1239 - DNA, 20 bp, Artificial sequence
  Synthetic oligonucleotide
gagtgcttgtgccagccttc

SEQ ID NO: 1240 - DNA, 20 bp, Artificial sequence
  Synthetic oligonucleotide
tgggtgagaaaaatatgaaa

SEQ ID NO: 1241 - DNA, 20 bp, Artificial sequence
  Synthetic oligonucleotide
gttcagcacactaaaacaaa

SEQ ID NO: 1242 - DNA, 20 bp, Artificial sequence
  Synthetic oligonucleotide
cactatattgcccatgctgc

SEQ ID NO: 1243 - DNA, 20 bp, Artificial sequence
  Synthetic oligonucleotide
acctatagtcagggcatggt

SEQ ID NO: 1244 - DNA, 20 bp, Artificial sequence
  Synthetic oligonucleotide
ctcactgcaacctcgatcac

SEQ ID NO: 1245 - DNA, 20 bp, Artificial sequence
  Synthetic oligonucleotide
aaaatacaaggccgggcgca

SEQ ID NO: 1246 - DNA, 20 bp, Artificial sequence
  Synthetic oligonucleotide
acttttatcaaatgaaagtt

SEQ ID NO: 1247 - DNA, 20 bp, Artificial sequence
  Synthetic oligonucleotide
catgaggatgctgtgttcaa

SEQ ID NO: 1248 - DNA, 20 bp, Artificial sequence
  Synthetic oligonucleotide
tacggatgggcctcttgaaa

SEQ ID NO: 1249 - DNA, 20 bp, Artificial sequence
  Synthetic oligonucleotide
catactaaaaatttaaaaac

SEQ ID NO: 1250 - DNA, 20 bp, Artificial sequence
  Synthetic oligonucleotide
ttaagctcaagatatcctga

SEQ ID NO: 1251 - DNA, 20 bp, Artificial sequence
  Synthetic oligonucleotide
cattctggctaaagatccca

SEQ ID NO: 1252 - DNA, 20 bp, Artificial sequence
  Synthetic oligonucleotide
tgaactttcttgatggttac

SEQ ID NO: 1253 - DNA, 20 bp, Artificial sequence
  Synthetic oligonucleotide
tgctcttaaagaaaaatggg

SEQ ID NO: 1254 - DNA, 20 bp, Artificial sequence
  Synthetic oligonucleotide
cagagagctcttttacgcat

SEQ ID NO: 1255 - DNA, 20 bp, Artificial sequence
  Synthetic oligonucleotide
ctgctaactggtttgccctt

SEQ ID NO: 1256 - DNA, 20 bp, Artificial sequence
  Synthetic oligonucleotide
ggccgctgagcgcatcggag

SEQ ID NO: 1257 - DNA, 20 bp, Artificial sequence
  Synthetic oligonucleotide
gagggaggcgagctctgccg

SEQ ID NO: 1258 - DNA, 20 bp, Artificial sequence
  Synthetic oligonucleotide
cttgtacttcacatttggag

SEQ ID NO: 1259 - DNA, 20 bp, Artificial sequence
  Synthetic oligonucleotide
agaattcgggttgaaatctg

SEQ ID NO: 1260 - DNA, 20 bp, Artificial sequence
  Synthetic oligonucleotide
ggtgatgtttcattgggttt

SEQ ID NO: 1261 - DNA, 20 bp, Artificial sequence
  Synthetic oligonucleotide
gtgctccgtgttactaagta

SEQ ID NO: 1262 - DNA, 20 bp, Artificial sequence
  Synthetic oligonucleotide
tctccttgttgtatggtaat

SEQ ID NO: 1263 - DNA, 20 bp, Artificial sequence
  Synthetic oligonucleotide
taaaaacaaaataaatgaaa

SEQ ID NO: 1264 - DNA, 20 bp, Artificial sequence
  Synthetic oligonucleotide
gtacctgcgggactctgaaa

SEQ ID NO: 1265 - DNA, 20 bp, Artificial sequence
  Synthetic oligonucleotide
tttactgaaactttgtcaag

SEQ ID NO: 1266 - DNA, 20 bp, Artificial sequence
  Synthetic oligonucleotide
attttttttaagtttttatt

SEQ ID NO: 1267 - DNA, 20 bp, Artificial sequence
  Synthetic oligonucleotide
ggagccccacgatttcaggg

SEQ ID NO: 1268 - DNA, 20 bp, Artificial sequence
  Synthetic oligonucleotide
ctgcgcccaccggccgagcc

SEQ ID NO: 1269 - DNA, 20 bp, Artificial sequence
  Synthetic oligonucleotide
aaaaatgttcactgcaccac

SEQ ID NO: 1270 - DNA, 20 bp, Artificial sequence
  Synthetic oligonucleotide
aaaggaacaccatgactgat

SEQ ID NO: 1271 - DNA, 20 bp, Artificial sequence
  Synthetic oligonucleotide
gaaccagactgcacaacagg

SEQ ID NO: 1272 - DNA, 20 bp, Artificial sequence
  Synthetic oligonucleotide
gctaaagcaggaggacagtt

SEQ ID NO: 1273 - DNA, 20 bp, Artificial sequence
  Synthetic oligonucleotide
atatcaataaaaaattactt

SEQ ID NO: 1274 - DNA, 20 bp, Artificial sequence
  Synthetic oligonucleotide
atcattacgaccattctgct

SEQ ID NO: 1275 - DNA, 20 bp, Artificial sequence
  Synthetic oligonucleotide
aggagcgcgccaccgtgcct

SEQ ID NO: 1276 - DNA, 20 bp, Artificial sequence
  Synthetic oligonucleotide
gaatttgaataggtcattta

SEQ ID NO: 1277 - DNA, 20 bp, Artificial sequence
  Synthetic oligonucleotide
ctgagatcaggagaccagcc

SEQ ID NO: 1278 - DNA, 20 bp, Artificial sequence
  Synthetic oligonucleotide
cctagacacaccaaaaaatc

SEQ ID NO: 1279 - DNA, 20 bp, Artificial sequence
  Synthetic oligonucleotide
atcagttagacaattaacta

SEQ ID NO: 1280 - DNA, 20 bp, Artificial sequence
  Synthetic oligonucleotide
tgctctctttgcgcctgtgt

SEQ ID NO: 1281 - DNA, 20 bp, Artificial sequence
  Synthetic oligonucleotide
tgtcatatacccactactca

SEQ ID NO: 1282 - DNA, 20 bp, Artificial sequence
  Synthetic oligonucleotide
cataaaattaaaatactaca

SEQ ID NO: 1283 - DNA, 20 bp, Artificial sequence
  Synthetic oligonucleotide
accacgcccggccaaagatg

SEQ ID NO: 1284 - DNA, 20 bp, Artificial sequence
  Synthetic oligonucleotide
aggaaactgaacctcagcag

SEQ ID NO: 1285 - DNA, 20 bp, Artificial sequence
  Synthetic oligonucleotide
cactgcttgcctggagaccc

SEQ ID NO: 1286 - DNA, 20 bp, Artificial sequence
  Synthetic oligonucleotide
gaaatgtaccctaagaaggg

SEQ ID NO: 1287 - DNA, 20 bp, Artificial sequence
  Synthetic oligonucleotide
tcttaagtacattaataata

SEQ ID NO: 1288 - DNA, 20 bp, Artificial sequence
  Synthetic oligonucleotide
cagagtgctatgtattaaat

SEQ ID NO: 1289 - DNA, 20 bp, Artificial sequence
  Synthetic oligonucleotide
gaacttaaaagtcacactga

SEQ ID NO: 1290 - DNA, 20 bp, Artificial sequence
  Synthetic oligonucleotide
aagtgcagcaataaagacag

SEQ ID NO: 1291 - DNA, 20 bp, Artificial sequence
  Synthetic oligonucleotide
atttctatatactctaaaaa

SEQ ID NO: 1292 - DNA, 20 bp, Artificial sequence
  Synthetic oligonucleotide
caataaaataaaaataaact

SEQ ID NO: 1293 - DNA, 20 bp, Artificial sequence
  Synthetic oligonucleotide
tagtaacctttttttttttg

SEQ ID NO: 1294 - DNA, 20 bp, Artificial sequence
  Synthetic oligonucleotide
gggtataatcaaagagacag

SEQ ID NO: 1295 - DNA, 20 bp, Artificial sequence
  Synthetic oligonucleotide
tacattcctaactaatcagc

SEQ ID NO: 1296 - DNA, 20 bp, Artificial sequence
  Synthetic oligonucleotide
aaaaacaaaaaaatgtgtat

SEQ ID NO: 1297 - DNA, 20 bp, Artificial sequence
  Synthetic oligonucleotide
tccagcccctgtatcccacc

SEQ ID NO: 1298 - DNA, 20 bp, Artificial sequence
  Synthetic oligonucleotide
ggaataaaagcattaatcca

SEQ ID NO: 1299 - DNA, 20 bp, Artificial sequence
  Synthetic oligonucleotide
caacaaaagcacatttaaat

SEQ ID NO: 1300 - DNA, 20 bp, Artificial sequence
  Synthetic oligonucleotide
tctgcagaaaaagaaaaaaa

SEQ ID NO: 1301 - DNA, 20 bp, Artificial sequence
  Synthetic oligonucleotide
atgaagcttgtttttcaaaa

SEQ ID NO: 1302 - DNA, 20 bp, Artificial sequence
  Synthetic oligonucleotide
ccaacagggtgctctttagc

SEQ ID NO: 1303 - DNA, 20 bp, Artificial sequence
  Synthetic oligonucleotide
aagttagtaacatactattg

SEQ ID NO: 1304 - DNA, 20 bp, Artificial sequence
  Synthetic oligonucleotide
aacttaactgacataaattc

SEQ ID NO: 1305 - DNA, 20 bp, Artificial sequence
  Synthetic oligonucleotide
acaccccgataccactaaaa

SEQ ID NO: 1306 - DNA, 20 bp, Artificial sequence
  Synthetic oligonucleotide
agaccatctaagtaatgtca

SEQ ID NO: 1307 - DNA, 20 bp, Artificial sequence
  Synthetic oligonucleotide
cttgctctactaatatctag

SEQ ID NO: 1308 - DNA, 20 bp, Artificial sequence
  Synthetic oligonucleotide
actttaaatggttgatttat

SEQ ID NO: 1309 - DNA, 20 bp, Artificial sequence
  Synthetic oligonucleotide
atgtgaagataattcaatgg

SEQ ID NO: 1310 - DNA, 20 bp, Artificial sequence
  Synthetic oligonucleotide
agcagaaaactgaaattctt

SEQ ID NO: 1311 - DNA, 20 bp, Artificial sequence
  Synthetic oligonucleotide
aattttaaaggccgggcacg

SEQ ID NO: 1312 - DNA, 20 bp, Artificial sequence
  Synthetic oligonucleotide
cgaattcagtaacacattaa

SEQ ID NO: 1313 - DNA, 20 bp, Artificial sequence
  Synthetic oligonucleotide
aagaactacaattttttttt

SEQ ID NO: 1314 - DNA, 20 bp, Artificial sequence
  Synthetic oligonucleotide
tcatagtcagtggacttggg

SEQ ID NO: 1315 - DNA, 20 bp, Artificial sequence
  Synthetic oligonucleotide
ccacatgtcagaaattgtgc

SEQ ID NO: 1316 - DNA, 20 bp, Artificial sequence
  Synthetic oligonucleotide
atggccatgtaaaaaaaaga

SEQ ID NO: 1317 - DNA, 20 bp, Artificial sequence
  Synthetic oligonucleotide
gtaggtatatataaagcaag

SEQ ID NO: 1318 - DNA, 20 bp, Artificial sequence
  Synthetic oligonucleotide
aagcaagtaaaaagataacc

SEQ ID NO: 1319 - DNA, 20 bp, Artificial sequence
  Synthetic oligonucleotide
tcacagtaagaaaagaaaca

SEQ ID NO: 1320 - DNA, 20 bp, Artificial sequence
  Synthetic oligonucleotide
gacaagacaagaaaagaaaa

SEQ ID NO: 1321 - DNA, 20 bp, Artificial sequence
  Synthetic oligonucleotide
taaacaaaaaagccactgaa

SEQ ID NO: 1322 - DNA, 20 bp, Artificial sequence
  Synthetic oligonucleotide
tagacatgaggatgctgtgt

SEQ ID NO: 1323 - DNA, 20 bp, Artificial sequence
  Synthetic oligonucleotide
aactaaagacaagtcaaatg

SEQ ID NO: 1324 - DNA, 20 bp, Artificial sequence
  Synthetic oligonucleotide
taatgttagcatatgtgtat

SEQ ID NO: 1325 - DNA, 20 bp, Artificial sequence
  Synthetic oligonucleotide
ctatttctgtactttttgcc

SEQ ID NO: 1326 - DNA, 20 bp, Artificial sequence
  Synthetic oligonucleotide
ttttgttatatatgctcatt

SEQ ID NO: 1327 - DNA, 20 bp, Artificial sequence
  Synthetic oligonucleotide
tgccagaatattttaacaag

SEQ ID NO: 1328 - DNA, 20 bp, Artificial sequence
  Synthetic oligonucleotide
agtttcacagtgttcgccag

SEQ ID NO: 1329 - DNA, 20 bp, Artificial sequence
  Synthetic oligonucleotide
acactggaggtgagctccaa

SEQ ID NO: 1330 - DNA, 20 bp, Artificial sequence
  Synthetic oligonucleotide
cctgcacacacacgcctcac

SEQ ID NO: 1331 - DNA, 20 bp, Artificial sequence
  Synthetic oligonucleotide
gctgcggccgctgagcgcat

SEQ ID NO: 1332 - DNA, 20 bp, Artificial sequence
  Synthetic oligonucleotide
aggcggagggaggcgagctc

SEQ ID NO: 1333 - DNA, 20 bp, Artificial sequence
  Synthetic oligonucleotide
acttgtacttcacatttgga

SEQ ID NO: 1334 - DNA, 20 bp, Artificial sequence
  Synthetic oligonucleotide
catcattttccagggccact

SEQ ID NO: 1335 - DNA, 20 bp, Artificial sequence
  Synthetic oligonucleotide
ccagaattcgggttgaaatc

SEQ ID NO: 1336 - DNA, 20 bp, Artificial sequence
  Synthetic oligonucleotide
aggtgatgtttcattgggtt

SEQ ID NO: 1337 - DNA, 20 bp, Artificial sequence
  Synthetic oligonucleotide
tgtgctccgtgttactaagt

SEQ ID NO: 1338 - DNA, 20 bp, Artificial sequence
  Synthetic oligonucleotide
tgtctccttgttgtatggta

SEQ ID NO: 1339 - DNA, 20 bp, Artificial sequence
  Synthetic oligonucleotide
tattttaaaaacaaaataaa

SEQ ID NO: 1340 - DNA, 20 bp, Artificial sequence
  Synthetic oligonucleotide
tttcggcaagcagagctggg

SEQ ID NO: 1341 - DNA, 20 bp, Artificial sequence
  Synthetic oligonucleotide
aagaatttactgaaactttg

SEQ ID NO: 1342 - DNA, 20 bp, Artificial sequence
  Synthetic oligonucleotide
tttaaattttttttaagttt

SEQ ID NO: 1343 - DNA, 20 bp, Artificial sequence
  Synthetic oligonucleotide
cacatggagccccacgattt

SEQ ID NO: 1344 - DNA, 20 bp, Artificial sequence
  Synthetic oligonucleotide
tgctgcgggaggctggacag

SEQ ID NO: 1345 - DNA, 20 bp, Artificial sequence
  Synthetic oligonucleotide
aataattacactgaagcaaa

SEQ ID NO: 1346 - DNA, 20 bp, Artificial sequence
  Synthetic oligonucleotide
tcctttaagtcaaaatatat

SEQ ID NO: 1347 - DNA, 20 bp, Artificial sequence
  Synthetic oligonucleotide
aaaaaaaacaggcctgttag

SEQ ID NO: 1348 - DNA, 20 bp, Artificial sequence
  Synthetic oligonucleotide
agaggctaaagcaggaggac

SEQ ID NO: 1349 - DNA, 20 bp, Artificial sequence
  Synthetic oligonucleotide
cctagcttagatataacctc

SEQ ID NO: 1350 - DNA, 20 bp, Artificial sequence
  Synthetic oligonucleotide
gcatcattacgaccattctg

SEQ ID NO: 1351 - DNA, 20 bp, Artificial sequence
  Synthetic oligonucleotide
aatcatatgttcacacaaaa

SEQ ID NO: 1352 - DNA, 20 bp, Artificial sequence
  Synthetic oligonucleotide
aataacattttttaatacca

SEQ ID NO: 1353 - DNA, 20 bp, Artificial sequence
  Synthetic oligonucleotide
catggcttaaagctcagaat

SEQ ID NO: 1354 - DNA, 20 bp, Artificial sequence
  Synthetic oligonucleotide
cttggtcatgaagccatgaa

SEQ ID NO: 1355 - DNA, 20 bp, Artificial sequence
  Synthetic oligonucleotide
acttaagtaactaatattta

SEQ ID NO: 1356 - DNA, 20 bp, Artificial sequence
  Synthetic oligonucleotide
ggaaaccccgagtcgggcaa

SEQ ID NO: 1357 - DNA, 20 bp, Artificial sequence
  Synthetic oligonucleotide
attactagtgtatctgtcat

SEQ ID NO: 1358 - DNA, 20 bp, Artificial sequence
  Synthetic oligonucleotide
aaacctccgtctcaaagaaa

SEQ ID NO: 1359 - DNA, 20 bp, Artificial sequence
  Synthetic oligonucleotide
gctaggactacaggtacgcg

SEQ ID NO: 1360 - DNA, 20 bp, Artificial sequence
  Synthetic oligonucleotide
aaattcctgaagtctaagga

SEQ ID NO: 1361 - DNA, 20 bp, Artificial sequence
  Synthetic oligonucleotide
atgcactgcttgcctggaga

SEQ ID NO: 1362 - DNA, 20 bp, Artificial sequence
  Synthetic oligonucleotide
gcaatgaaactgttctatta

SEQ ID NO: 1363 - DNA, 20 bp, Artificial sequence
  Synthetic oligonucleotide
tccatcatttaaaaatcctc

SEQ ID NO: 1364 - DNA, 20 bp, Artificial sequence
  Synthetic oligonucleotide
agtaataaaaatttaatgac

SEQ ID NO: 1365 - DNA, 20 bp, Artificial sequence
  Synthetic oligonucleotide
gttagcatcaagaacttaaa

SEQ ID NO: 1366 - DNA, 20 bp, Artificial sequence
  Synthetic oligonucleotide
tcaagtgcagcaataaagac

SEQ ID NO: 1367 - DNA, 20 bp, Artificial sequence
  Synthetic oligonucleotide
ttttatgctagaggttttta

SEQ ID NO: 1368 - DNA, 20 bp, Artificial sequence
  Synthetic oligonucleotide
acaataaaataaaaataaac

SEQ ID NO: 1369 - DNA, 20 bp, Artificial sequence
  Synthetic oligonucleotide
agataaaaggcactgcaatt

SEQ ID NO: 1370 - DNA, 20 bp, Artificial sequence
  Synthetic oligonucleotide
gaaaaaaaaaatctacagtg

SEQ ID NO: 1371 - DNA, 20 bp, Artificial sequence
  Synthetic oligonucleotide
ctgacaagcaggaagaaaga

SEQ ID NO: 1372 - DNA, 20 bp, Artificial sequence
  Synthetic oligonucleotide
cgtgtatagctgggagcggt

SEQ ID NO: 1373 - DNA, 20 bp, Artificial sequence
  Synthetic oligonucleotide
aaagaatattaattttccat

SEQ ID NO: 1374 - DNA, 20 bp, Artificial sequence
  Synthetic oligonucleotide
ccagcaaatttaagcatgga

SEQ ID NO: 1375 - DNA, 20 bp, Artificial sequence
  Synthetic oligonucleotide
ctcactacaataacaacaac

SEQ ID NO: 1376 - DNA, 20 bp, Artificial sequence
  Synthetic oligonucleotide
gcttggaaagctgaggcagt

SEQ ID NO: 1377 - DNA, 20 bp, Artificial sequence
  Synthetic oligonucleotide
gaaaatgaagcttgtttttc

SEQ ID NO: 1378 - DNA, 20 bp, Artificial sequence
  Synthetic oligonucleotide
caatgccccagggtttattc

SEQ ID NO: 1379 - DNA, 20 bp, Artificial sequence
  Synthetic oligonucleotide
ctttccaaatttaaatagct

SEQ ID NO: 1380 - DNA, 20 bp, Artificial sequence
  Synthetic oligonucleotide
ttttagcataacttaactga

SEQ ID NO: 1381 - DNA, 20 bp, Artificial sequence
  Synthetic oligonucleotide
catgataaaatatttttaac

SEQ ID NO: 1382 - DNA, 20 bp, Artificial sequence
  Synthetic oligonucleotide
aatcatgttattctcaaaat

SEQ ID NO: 1383 - DNA, 20 bp, Artificial sequence
  Synthetic oligonucleotide
acaccagagtccagtacatc

SEQ ID NO: 1384 - DNA, 20 bp, Artificial sequence
  Synthetic oligonucleotide
attttaaaaaccactgattt

SEQ ID NO: 1385 - DNA, 20 bp, Artificial sequence
  Synthetic oligonucleotide
aacaagcatgtgaagataat

SEQ ID NO: 1386 - DNA, 20 bp, Artificial sequence
  Synthetic oligonucleotide
ctcctgcctcagtcttgcga

SEQ ID NO: 1387 - DNA, 20 bp, Artificial sequence
  Synthetic oligonucleotide
aatgatttaaaataatttta

SEQ ID NO: 1388 - DNA, 20 bp, Artificial sequence
  Synthetic oligonucleotide
aaccgaattcagtaacacat

SEQ ID NO: 1389 - DNA, 20 bp, Artificial sequence
  Synthetic oligonucleotide
caggaagaataaaaaatgaa

SEQ ID NO: 1390 - DNA, 20 bp, Artificial sequence
  Synthetic oligonucleotide
tgcaattcctggacaagtca

SEQ ID NO: 1391 - DNA, 20 bp, Artificial sequence
  Synthetic oligonucleotide
cacagtcaccaaagcactca

SEQ ID NO: 1392 - DNA, 20 bp, Artificial sequence
  Synthetic oligonucleotide
gcccaagatcacatctaatt

SEQ ID NO: 1393 - DNA, 20 bp, Artificial sequence
  Synthetic oligonucleotide
ataactgtaggtatatataa

SEQ ID NO: 1394 - DNA, 20 bp, Artificial sequence
  Synthetic oligonucleotide
acagataaattgaacttcat

SEQ ID NO: 1395 - DNA, 20 bp, Artificial sequence
  Synthetic oligonucleotide
tactaaaagtagtaacttta

SEQ ID NO: 1396 - DNA, 20 bp, Artificial sequence
  Synthetic oligonucleotide
aggctgaggtagaaagataa

SEQ ID NO: 1397 - DNA, 20 bp, Artificial sequence
  Synthetic oligonucleotide
ctccttctggtaaacaaaaa

SEQ ID NO: 1398 - DNA, 20 bp, Artificial sequence
  Synthetic oligonucleotide
cacactggaagagacaaaca

SEQ ID NO: 1399 - DNA, 20 bp, Artificial sequence
  Synthetic oligonucleotide
ccgttaagacaactaaagac

SEQ ID NO: 1400 - DNA, 20 bp, Artificial sequence
  Synthetic oligonucleotide
aggtttttgacaaaagccct

SEQ ID NO: 1401 - DNA, 20 bp, Artificial sequence
  Synthetic oligonucleotide
tctccatgaaggagcaacta

SEQ ID NO: 1402 - DNA, 20 bp, Artificial sequence
  Synthetic oligonucleotide
agacaaaaaaggaaccaggg

SEQ ID NO: 1403 - DNA, 20 bp, Artificial sequence
  Synthetic oligonucleotide
ttccttcatatccagtttag

SEQ ID NO: 1404 - DNA, 20 bp, Artificial sequence
  Synthetic oligonucleotide
gacggagtttcacagtgttc

SEQ ID NO: 1405 - DNA, 20 bp, Artificial sequence
  Synthetic oligonucleotide
acacctttcacctgtagcag

SEQ ID NO: 1406 - DNA, 20 bp, Artificial sequence
  Synthetic oligonucleotide
agcactggccctgcctgcca

SEQ ID NO: 1407 - DNA, 20 bp, Artificial sequence
  Synthetic oligonucleotide
gaggagctgcggccgctgag

SEQ ID NO: 1408 - DNA, 20 bp, Artificial sequence
  Synthetic oligonucleotide
gtctgaggcggagggaggcg

SEQ ID NO: 1409 - DNA, 20 bp, Artificial sequence
  Synthetic oligonucleotide
cacttgtacttcacatttgg

SEQ ID NO: 1410 - DNA, 20 bp, Artificial sequence
  Synthetic oligonucleotide
atcatcattttccagggcca

SEQ ID NO: 1411 - DNA, 20 bp, Artificial sequence
  Synthetic oligonucleotide
accagaattcgggttgaaat

SEQ ID NO: 1412 - DNA, 20 bp, Artificial sequence
  Synthetic oligonucleotide
ctaggtgatgtttcattggg

SEQ ID NO: 1413 - DNA, 20 bp, Artificial sequence
  Synthetic oligonucleotide
cttgtgctccgtgttactaa

SEQ ID NO: 1414 - DNA, 20 bp, Artificial sequence
  Synthetic oligonucleotide
cttgtctccttgttgtatgg

SEQ ID NO: 1415 - DNA, 20 bp, Artificial sequence
  Synthetic oligonucleotide
atatatattttaaaaacaaa

SEQ ID NO: 1416 - DNA, 20 bp, Artificial sequence
  Synthetic oligonucleotide
tccagtttcggcaagcagag

SEQ ID NO: 1417 - DNA, 20 bp, Artificial sequence
  Synthetic oligonucleotide
acggtaagaatttactgaaa

SEQ ID NO: 1418 - DNA, 20 bp, Artificial sequence
  Synthetic oligonucleotide
actttttttattttttaaat

SEQ ID NO: 1419 - DNA, 20 bp, Artificial sequence
  Synthetic oligonucleotide
gaggccacatggagccccac

SEQ ID NO: 1420 - DNA, 20 bp, Artificial sequence
  Synthetic oligonucleotide
tccggaggagcccggtgcct

SEQ ID NO: 1421 - DNA, 20 bp, Artificial sequence
  Synthetic oligonucleotide
ttcttgacactggaagtaat

SEQ ID NO: 1422 - DNA, 20 bp, Artificial sequence
  Synthetic oligonucleotide
ttgagatcctcctttaagtc

SEQ ID NO: 1423 - DNA, 20 bp, Artificial sequence
  Synthetic oligonucleotide
gccaaaatcaaggttacaaa

SEQ ID NO: 1424 - DNA, 20 bp, Artificial sequence
  Synthetic oligonucleotide
ataaagaactctccagacca

SEQ ID NO: 1425 - DNA, 20 bp, Artificial sequence
  Synthetic oligonucleotide
attcaaatttaactgagtgt

SEQ ID NO: 1426 - DNA, 20 bp, Artificial sequence
  Synthetic oligonucleotide
gcattggcctactccgtgaa

SEQ ID NO: 1427 - DNA, 20 bp, Artificial sequence
  Synthetic oligonucleotide
aaccaagagaaataaaatca

SEQ ID NO: 1428 - DNA, 20 bp, Artificial sequence
  Synthetic oligonucleotide
gctagtgactcaagttcctg

SEQ ID NO: 1429 - DNA, 20 bp, Artificial sequence
  Synthetic oligonucleotide
agttaatgggaaacatgatc

SEQ ID NO: 1430 - DNA, 20 bp, Artificial sequence
  Synthetic oligonucleotide
agggataaaaggcttggtca

SEQ ID NO: 1431 - DNA, 20 bp, Artificial sequence
  Synthetic oligonucleotide
tgaaagaagccttctcaaac

SEQ ID NO: 1432 - DNA, 20 bp, Artificial sequence
  Synthetic oligonucleotide
atttttgacaagctgaccgt

SEQ ID NO: 1433 - DNA, 20 bp, Artificial sequence
  Synthetic oligonucleotide
gatctgtattataattacta

SEQ ID NO: 1434 - DNA, 20 bp, Artificial sequence
  Synthetic oligonucleotide
cgccctgactcacgcctgta

SEQ ID NO: 1435 - DNA, 20 bp, Artificial sequence
  Synthetic oligonucleotide
atccagaatgcagtaaatgc

SEQ ID NO: 1436 - DNA, 20 bp, Artificial sequence
  Synthetic oligonucleotide
aaacaatggacttgaattaa

SEQ ID NO: 1437 - DNA, 20 bp, Artificial sequence
  Synthetic oligonucleotide
atttccaaacttaaaatata

SEQ ID NO: 1438 - DNA, 20 bp, Artificial sequence
  Synthetic oligonucleotide
gatggaagacaaatcaatgg

SEQ ID NO: 1439 - DNA, 20 bp, Artificial sequence
  Synthetic oligonucleotide
agctcatcaaggtaccagtt

SEQ ID NO: 1440 - DNA, 20 bp, Artificial sequence
  Synthetic oligonucleotide
gaaatgaagatctaataaag

SEQ ID NO: 1441 - DNA, 20 bp, Artificial sequence
  Synthetic oligonucleotide
cttttaaactttattgaaat

SEQ ID NO: 1442 - DNA, 20 bp, Artificial sequence
  Synthetic oligonucleotide
tgaaggaaaagaagcccagg

SEQ ID NO: 1443 - DNA, 20 bp, Artificial sequence
  Synthetic oligonucleotide
atttttagtagagccatgtc

SEQ ID NO: 1444 - DNA, 20 bp, Artificial sequence
  Synthetic oligonucleotide
aatttctttaaaaatacaat

SEQ ID NO: 1445 - DNA, 20 bp, Artificial sequence
  Synthetic oligonucleotide
tagtttgactaagcccatta

SEQ ID NO: 1446 - DNA, 20 bp, Artificial sequence
  Synthetic oligonucleotide
accacacttattttctattt

SEQ ID NO: 1447 - DNA, 20 bp, Artificial sequence
  Synthetic oligonucleotide
tccaaggtcatcaatgccct

SEQ ID NO: 1448 - DNA, 20 bp, Artificial sequence
  Synthetic oligonucleotide
ctggagtggcattaaaaata

SEQ ID NO: 1449 - DNA, 20 bp, Artificial sequence
  Synthetic oligonucleotide
tcaaagaatattaattttcc

SEQ ID NO: 1450 - DNA, 20 bp, Artificial sequence
  Synthetic oligonucleotide
gccaaaataagaaatctgag

SEQ ID NO: 1451 - DNA, 20 bp, Artificial sequence
  Synthetic oligonucleotide
atacactcactacaataaca

SEQ ID NO: 1452 - DNA, 20 bp, Artificial sequence
  Synthetic oligonucleotide
ttgcagtgtgacagagcaag

SEQ ID NO: 1453 - DNA, 20 bp, Artificial sequence
  Synthetic oligonucleotide
atcaaagacaaatgcactaa

SEQ ID NO: 1454 - DNA, 20 bp, Artificial sequence
  Synthetic oligonucleotide
ttgaactatttcagtgcact

SEQ ID NO: 1455 - DNA, 20 bp, Artificial sequence
  Synthetic oligonucleotide
ctctattttcatctaacttt

SEQ ID NO: 1456 - DNA, 20 bp, Artificial sequence
  Synthetic oligonucleotide
gtacattttaaccctttgag

SEQ ID NO: 1457 - DNA, 20 bp, Artificial sequence
  Synthetic oligonucleotide
acatgataaaatatttttaa

SEQ ID NO: 1458 - DNA, 20 bp, Artificial sequence
  Synthetic oligonucleotide
ctccaaaactatgcttatac

SEQ ID NO: 1459 - DNA, 20 bp, Artificial sequence
  Synthetic oligonucleotide
tgtgtacaaagtataaatct

SEQ ID NO: 1460 - DNA, 20 bp, Artificial sequence
  Synthetic oligonucleotide
cgactgctaaactgggcacg

SEQ ID NO: 1461 - DNA, 20 bp, Artificial sequence
  Synthetic oligonucleotide
ttccaacaagcatgtgaaga

SEQ ID NO: 1462 - DNA, 20 bp, Artificial sequence
  Synthetic oligonucleotide
tcctctctgcactatactaa

SEQ ID NO: 1463 - DNA, 20 bp, Artificial sequence
  Synthetic oligonucleotide
aatttagaaagaacgaataa

SEQ ID NO: 1464 - DNA, 20 bp, Artificial sequence
  Synthetic oligonucleotide
tacaaaaccaaaggacacat

SEQ ID NO: 1465 - DNA, 20 bp, Artificial sequence
  Synthetic oligonucleotide
agaaaaatacagaatattgt

SEQ ID NO: 1466 - DNA, 20 bp, Artificial sequence
  Synthetic oligonucleotide
ggcactatggtctgtaatcc

SEQ ID NO: 1467 - DNA, 20 bp, Artificial sequence
  Synthetic oligonucleotide
atatcttaaataactttagt

SEQ ID NO: 1468 - DNA, 20 bp, Artificial sequence
  Synthetic oligonucleotide
ataaacctgacagcctagct

SEQ ID NO: 1469 - DNA, 20 bp, Artificial sequence
  Synthetic oligonucleotide
ggctaagatttctatttttt

SEQ ID NO: 1470 - DNA, 20 bp, Artificial sequence
  Synthetic oligonucleotide
agcaacaaaagaaaaaacaa

SEQ ID NO: 1471 - DNA, 20 bp, Artificial sequence
  Synthetic oligonucleotide
ggctcttcaaaaaaaaccgc

SEQ ID NO: 1472 - DNA, 20 bp, Artificial sequence
  Synthetic oligonucleotide
ctgggtgtgatggctcatcc

SEQ ID NO: 1473 - DNA, 20 bp, Artificial sequence
  Synthetic oligonucleotide
cacctccttctggtaaacaa

SEQ ID NO: 1474 - DNA, 20 bp, Artificial sequence
  Synthetic oligonucleotide
tagatagagtatgttttcag

SEQ ID NO: 1475 - DNA, 20 bp, Artificial sequence
  Synthetic oligonucleotide
atattcagtccccgttaaga

SEQ ID NO: 1476 - DNA, 20 bp, Artificial sequence
  Synthetic oligonucleotide
ggtaaaagcatcaccataaa

SEQ ID NO: 1477 - DNA, 20 bp, Artificial sequence
  Synthetic oligonucleotide
ctttctccatgaaggagcaa

SEQ ID NO: 1478 - DNA, 20 bp, Artificial sequence
  Synthetic oligonucleotide
aagcagggtaggaagaaaat

SEQ ID NO: 1479 - DNA, 20 bp, Artificial sequence
  Synthetic oligonucleotide
tctaggatcacctgtgcatc

SEQ ID NO: 1480 - DNA, 20 bp, Artificial sequence
  Synthetic oligonucleotide
tcaacatgtatcttaaatgt

SEQ ID NO: 1481 - DNA, 20 bp, Artificial sequence
  Synthetic oligonucleotide
agacagcaaccactgagatg

SEQ ID NO: 1482 - DNA, 20 bp, Artificial sequence
  Synthetic oligonucleotide
ctcggctcccggaagcctca

SEQ ID NO: 1483 - DNA, 20 bp, Artificial sequence
  Synthetic oligonucleotide
actccgaggagctgcggccg

SEQ ID NO: 1484 - DNA, 20 bp, Artificial sequence
  Synthetic oligonucleotide
aaacagtctgaggcggaggg

SEQ ID NO: 1485 - DNA, 20 bp, Artificial sequence
  Synthetic oligonucleotide
ttttctcatgtgcggcatca

SEQ ID NO: 1486 - DNA, 20 bp, Artificial sequence
  Synthetic oligonucleotide
tatcatcattttccagggcc

SEQ ID NO: 1487 - DNA, 20 bp, Artificial sequence
  Synthetic oligonucleotide
aaccagaattcgggttgaaa

SEQ ID NO: 1488 - DNA, 20 bp, Artificial sequence
  Synthetic oligonucleotide
gctaggtgatgtttcattgg

SEQ ID NO: 1489 - DNA, 20 bp, Artificial sequence
  Synthetic oligonucleotide
gaagtctgaaccccttggga

SEQ ID NO: 1490 - DNA, 20 bp, Artificial sequence
  Synthetic oligonucleotide
attggcgcatgggcagttgg

SEQ ID NO: 1491 - DNA, 20 bp, Artificial sequence
  Synthetic oligonucleotide
tcaacatatatattttaaaa

SEQ ID NO: 1492 - DNA, 20 bp, Artificial sequence
  Synthetic oligonucleotide
taacttccagtttcggcaag

SEQ ID NO: 1493 - DNA, 20 bp, Artificial sequence
  Synthetic oligonucleotide
gtttgacggtaagaatttac

SEQ ID NO: 1494 - DNA, 20 bp, Artificial sequence
  Synthetic oligonucleotide
tttttaaaactttttttatt

SEQ ID NO: 1495 - DNA, 20 bp, Artificial sequence
  Synthetic oligonucleotide
tgccggaggccacatggagc

SEQ ID NO: 1496 - DNA, 20 bp, Artificial sequence
  Synthetic oligonucleotide
cagaccctgatgattccgga

SEQ ID NO: 1497 - DNA, 20 bp, Artificial sequence
  Synthetic oligonucleotide
aaccaagtaccctcattaat

SEQ ID NO: 1498 - DNA, 20 bp, Artificial sequence
  Synthetic oligonucleotide
ccgcactcattgcaacctcc

SEQ ID NO: 1499 - DNA, 20 bp, Artificial sequence
  Synthetic oligonucleotide
caaaataaataaataaccaa

SEQ ID NO: 1500 - DNA, 20 bp, Artificial sequence
  Synthetic oligonucleotide
aaaagttctcaaagaggcca

SEQ ID NO: 1501 - DNA, 20 bp, Artificial sequence
  Synthetic oligonucleotide
gttcatcaaaaattcaaatt

SEQ ID NO: 1502 - DNA, 20 bp, Artificial sequence
  Synthetic oligonucleotide
atgaactcctgctgcctggg

SEQ ID NO: 1503 - DNA, 20 bp, Artificial sequence
  Synthetic oligonucleotide
caatctcatttctatgcatt

SEQ ID NO: 1504 - DNA, 20 bp, Artificial sequence
  Synthetic oligonucleotide
cctgggtttaagtgaccctc

SEQ ID NO: 1505 - DNA, 20 bp, Artificial sequence
  Synthetic oligonucleotide
ttagtttcatggaaaatttg

SEQ ID NO: 1506 - DNA, 20 bp, Artificial sequence
  Synthetic oligonucleotide
ccttgagtccctctagagaa

SEQ ID NO: 1507 - DNA, 20 bp, Artificial sequence
  Synthetic oligonucleotide
atgtcacctcctgaaagaag

SEQ ID NO: 1508 - DNA, 20 bp, Artificial sequence
  Synthetic oligonucleotide
tcattttattctgctttgct

SEQ ID NO: 1509 - DNA, 20 bp, Artificial sequence
  Synthetic oligonucleotide
aataatacttaatcctactc

SEQ ID NO: 1510 - DNA, 20 bp, Artificial sequence
  Synthetic oligonucleotide
agaaaaccataattaatgca

SEQ ID NO: 1511 - DNA, 20 bp, Artificial sequence
  Synthetic oligonucleotide
gaatatattaactgatacca

SEQ ID NO: 1512 - DNA, 20 bp, Artificial sequence
  Synthetic oligonucleotide
acttttcctcactttcttct

SEQ ID NO: 1513 - DNA, 20 bp, Artificial sequence
  Synthetic oligonucleotide
acaggctaaataagctgaaa

SEQ ID NO: 1514 - DNA, 20 bp, Artificial sequence
  Synthetic oligonucleotide
ggaaggacacaaaccgtaag

SEQ ID NO: 1515 - DNA, 20 bp, Artificial sequence
  Synthetic oligonucleotide
tctttagctcatcaaggtac

SEQ ID NO: 1516 - DNA, 20 bp, Artificial sequence
  Synthetic oligonucleotide
gttttgaaataagatacctg

SEQ ID NO: 1517 - DNA, 20 bp, Artificial sequence
  Synthetic oligonucleotide
atgcatgaatataactttta

SEQ ID NO: 1518 - DNA, 20 bp, Artificial sequence
  Synthetic oligonucleotide
agctggcagtgtgtgtcatg

SEQ ID NO: 1519 - DNA, 20 bp, Artificial sequence
  Synthetic oligonucleotide
caggtgcccgtcacctcgcc

SEQ ID NO: 1520 - DNA, 20 bp, Artificial sequence
  Synthetic oligonucleotide
tgttttgcaactccctcagt

SEQ ID NO: 1521 - DNA, 20 bp, Artificial sequence
  Synthetic oligonucleotide
gtgagaggtacaaattggat

SEQ ID NO: 1522 - DNA, 20 bp, Artificial sequence
  Synthetic oligonucleotide
acaatatttgccttggtgga

SEQ ID NO: 1523 - DNA, 20 bp, Artificial sequence
  Synthetic oligonucleotide
ataaagatgtaaatttctct

SEQ ID NO: 1524 - DNA, 20 bp, Artificial sequence
  Synthetic oligonucleotide
tagactggagtggcattaaa

SEQ ID NO: 1525 - DNA, 20 bp, Artificial sequence
  Synthetic oligonucleotide
ccaatgccataagtcaaaga

SEQ ID NO: 1526 - DNA, 20 bp, Artificial sequence
  Synthetic oligonucleotide
ctctgctgaggaatataagc

SEQ ID NO: 1527 - DNA, 20 bp, Artificial sequence
  Synthetic oligonucleotide
cccctacaagtaaaatgaca

SEQ ID NO: 1528 - DNA, 20 bp, Artificial sequence
  Synthetic oligonucleotide
ggcaataagaatatgaacag

SEQ ID NO: 1529 - DNA, 20 bp, Artificial sequence
  Synthetic oligonucleotide
atttattcatcataaattaa

SEQ ID NO: 1530 - DNA, 20 bp, Artificial sequence
  Synthetic oligonucleotide
cagttgaactatttcagtgc

SEQ ID NO: 1531 - DNA, 20 bp, Artificial sequence
  Synthetic oligonucleotide
aaacttagtgttctctattt

SEQ ID NO: 1532 - DNA, 20 bp, Artificial sequence
  Synthetic oligonucleotide
atgatatgaaggaaagtata

SEQ ID NO: 1533 - DNA, 20 bp, Artificial sequence
  Synthetic oligonucleotide
tttgtaaagaaatatgttac

SEQ ID NO: 1534 - DNA, 20 bp, Artificial sequence
  Synthetic oligonucleotide
ctataatgctattctgagtg

SEQ ID NO: 1535 - DNA, 20 bp, Artificial sequence
  Synthetic oligonucleotide
aaggagagatgttaagtaaa

SEQ ID NO: 1536 - DNA, 20 bp, Artificial sequence
  Synthetic oligonucleotide
gaagggctggaggcaaatgt

SEQ ID NO: 1537 - DNA, 20 bp, Artificial sequence
  Synthetic oligonucleotide
tttgtagtcaacagacttcc

SEQ ID NO: 1538 - DNA, 20 bp, Artificial sequence
  Synthetic oligonucleotide
aatatagcactctgctgtat

SEQ ID NO: 1539 - DNA, 20 bp, Artificial sequence
  Synthetic oligonucleotide
ggagaagaagggaaatgagg

SEQ ID NO: 1540 - DNA, 20 bp, Artificial sequence
  Synthetic oligonucleotide
ctattaccctatacaaaacc

SEQ ID NO: 1541 - DNA, 20 bp, Artificial sequence
  Synthetic oligonucleotide
ctcactggtaacaagtacac

SEQ ID NO: 1542 - DNA, 20 bp, Artificial sequence
  Synthetic oligonucleotide
aaggaaaaagacaccaaaaa

SEQ ID NO: 1543 - DNA, 20 bp, Artificial sequence
  Synthetic oligonucleotide
aaggaaacaattatacttaa

SEQ ID NO: 1544 - DNA, 20 bp, Artificial sequence
  Synthetic oligonucleotide
agattatcctaactatgttt

SEQ ID NO: 1545 - DNA, 20 bp, Artificial sequence
  Synthetic oligonucleotide
tttcaattgatcctcccacc

SEQ ID NO: 1546 - DNA, 20 bp, Artificial sequence
  Synthetic oligonucleotide
ttcataggagtaaatctctg

SEQ ID NO: 1547 - DNA, 20 bp, Artificial sequence
  Synthetic oligonucleotide
cattaaaattaacaatactg

SEQ ID NO: 1548 - DNA, 20 bp, Artificial sequence
  Synthetic oligonucleotide
gtgggaaaaaaatacaagac

SEQ ID NO: 1549 - DNA, 20 bp, Artificial sequence
  Synthetic oligonucleotide
gttacatattattttatcta

SEQ ID NO: 1550 - DNA, 20 bp, Artificial sequence
  Synthetic oligonucleotide
aaaggtcaggttattcttag

SEQ ID NO: 1551 - DNA, 20 bp, Artificial sequence
  Synthetic oligonucleotide
cataatgaacttttaaccta

SEQ ID NO: 1552 - DNA, 20 bp, Artificial sequence
  Synthetic oligonucleotide
tcttcctaatggctctagtt

SEQ ID NO: 1553 - DNA, 20 bp, Artificial sequence
  Synthetic oligonucleotide
ggaactcttgtgcctccgcc

SEQ ID NO: 1554 - DNA, 20 bp, Artificial sequence
  Synthetic oligonucleotide
ttccttgataggccagttaa

SEQ ID NO: 1555 - DNA, 20 bp, Artificial sequence
  Synthetic oligonucleotide
agggcaaggcaaagagccag

SEQ ID NO: 1556 - DNA, 20 bp, Artificial sequence
  Synthetic oligonucleotide
ccaatcaccttattatcaac

SEQ ID NO: 1557 - DNA, 20 bp, Artificial sequence
  Synthetic oligonucleotide
cagacagcaaccactgagat

SEQ ID NO: 1558 - DNA, 20 bp, Artificial sequence
  Synthetic oligonucleotide
ctgtataccatcagaacaca

SEQ ID NO: 1559 - DNA, 20 bp, Artificial sequence
  Synthetic oligonucleotide
gcgggactccgaggagctgc

SEQ ID NO: 1560 - DNA, 20 bp, Artificial sequence
  Synthetic oligonucleotide
taccaaaacagtctgaggcg

SEQ ID NO: 1561 - DNA, 20 bp, Artificial sequence
  Synthetic oligonucleotide
acttttctcatgtgcggcat

SEQ ID NO: 1562 - DNA, 20 bp, Artificial sequence
  Synthetic oligonucleotide
ctatcatcattttccagggc

SEQ ID NO: 1563 - DNA, 20 bp, Artificial sequence
  Synthetic oligonucleotide
tgaaccagaattcgggttga

SEQ ID NO: 1564 - DNA, 20 bp, Artificial sequence
  Synthetic oligonucleotide
agctaggtgatgtttcattg

SEQ ID NO: 1565 - DNA, 20 bp, Artificial sequence
  Synthetic oligonucleotide
tggaagtctgaaccccttgg

SEQ ID NO: 1566 - DNA, 20 bp, Artificial sequence
  Synthetic oligonucleotide
tcattggcgcatgggcagtt

SEQ ID NO: 1567 - DNA, 20 bp, Artificial sequence
  Synthetic oligonucleotide
agaaatcaacatatatattt

SEQ ID NO: 1568 - DNA, 20 bp, Artificial sequence
  Synthetic oligonucleotide
taaaaaataaataacttcca

SEQ ID NO: 1569 - DNA, 20 bp, Artificial sequence
  Synthetic oligonucleotide
cgtcagtttgacggtaagaa

SEQ ID NO: 1570 - DNA, 20 bp, Artificial sequence
  Synthetic oligonucleotide
ttcagtttttaaaacttttt

SEQ ID NO: 1571 - DNA, 20 bp, Artificial sequence
  Synthetic oligonucleotide
ccttcccttccccaggtggg

SEQ ID NO: 1572 - DNA, 20 bp, Artificial sequence
  Synthetic oligonucleotide
ctcctagcatttccgaaatt

SEQ ID NO: 1573 - DNA, 20 bp, Artificial sequence
  Synthetic oligonucleotide
ttcctcaggaatttcattcc

SEQ ID NO: 1574 - DNA, 20 bp, Artificial sequence
  Synthetic oligonucleotide
actgcaacctccgcactcat

SEQ ID NO: 1575 - DNA, 20 bp, Artificial sequence
  Synthetic oligonucleotide
aaaaattttgctgggcatag

SEQ ID NO: 1576 - DNA, 20 bp, Artificial sequence
  Synthetic oligonucleotide
atctgcctctgaaaacattg

SEQ ID NO: 1577 - DNA, 20 bp, Artificial sequence
  Synthetic oligonucleotide
gatgctcagttaaatttcaa

SEQ ID NO: 1578 - DNA, 20 bp, Artificial sequence
  Synthetic oligonucleotide
acttcatgaactcctgctgc

SEQ ID NO: 1579 - DNA, 20 bp, Artificial sequence
  Synthetic oligonucleotide
gtaccctggaaaaataaaca

SEQ ID NO: 1580 - DNA, 20 bp, Artificial sequence
  Synthetic oligonucleotide
ctccaattcctgggtttaag

SEQ ID NO: 1581 - DNA, 20 bp, Artificial sequence
  Synthetic oligonucleotide
acaaagttaagttctacagg

SEQ ID NO: 1582 - DNA, 20 bp, Artificial sequence
  Synthetic oligonucleotide
cagtgcctttaccccttgag

SEQ ID NO: 1583 - DNA, 20 bp, Artificial sequence
  Synthetic oligonucleotide
cataagggtaccacatacct

SEQ ID NO: 1584 - DNA, 20 bp, Artificial sequence
  Synthetic oligonucleotide
gtgtacatgtgatggcaata

SEQ ID NO: 1585 - DNA, 20 bp, Artificial sequence
  Synthetic oligonucleotide
tccaaggcattttttaaata

SEQ ID NO: 1586 - DNA, 20 bp, Artificial sequence
  Synthetic oligonucleotide
ttaagaacgaaagaaaacca

SEQ ID NO: 1587 - DNA, 20 bp, Artificial sequence
  Synthetic oligonucleotide
caccttctgcttctgatgtg

SEQ ID NO: 1588 - DNA, 20 bp, Artificial sequence
  Synthetic oligonucleotide
cattctgaggccagtcctag

SEQ ID NO: 1589 - DNA, 20 bp, Artificial sequence
  Synthetic oligonucleotide
ctactaattttccccaataa

SEQ ID NO: 1590 - DNA, 20 bp, Artificial sequence
  Synthetic oligonucleotide
ttgactaaacatgacataaa

SEQ ID NO: 1591 - DNA, 20 bp, Artificial sequence
  Synthetic oligonucleotide
ctttacaaaataaaatttgt

SEQ ID NO: 1592 - DNA, 20 bp, Artificial sequence
  Synthetic oligonucleotide
cactaaaccactgtaagttt

SEQ ID NO: 1593 - DNA, 20 bp, Artificial sequence
  Synthetic oligonucleotide
gagaccaaaggaaacttatt

SEQ ID NO: 1594 - DNA, 20 bp, Artificial sequence
  Synthetic oligonucleotide
tacacacatgataggaggga

SEQ ID NO: 1595 - DNA, 20 bp, Artificial sequence
  Synthetic oligonucleotide
agtgcagcaccaccatctcg

SEQ ID NO: 1596 - DNA, 20 bp, Artificial sequence
  Synthetic oligonucleotide
gatagtaagtatattagcat

SEQ ID NO: 1597 - DNA, 20 bp, Artificial sequence
  Synthetic oligonucleotide
tttaagtaataaaaagcagt

SEQ ID NO: 1598 - DNA, 20 bp, Artificial sequence
  Synthetic oligonucleotide
aaatgagaaatctggaagac

SEQ ID NO: 1599 - DNA, 20 bp, Artificial sequence
  Synthetic oligonucleotide
aaatttcacttgaaggttag

SEQ ID NO: 1600 - DNA, 20 bp, Artificial sequence
  Synthetic oligonucleotide
tccaacatagactggagtgg

SEQ ID NO: 1601 - DNA, 20 bp, Artificial sequence
  Synthetic oligonucleotide
tctaatctacaggcaactgt

SEQ ID NO: 1602 - DNA, 20 bp, Artificial sequence
  Synthetic oligonucleotide
ggctctgctgaggaatataa

SEQ ID NO: 1603 - DNA, 20 bp, Artificial sequence
  Synthetic oligonucleotide
cttatttggctgggtgttaa

SEQ ID NO: 1604 - DNA, 20 bp, Artificial sequence
  Synthetic oligonucleotide
aactactattaagagttctg

SEQ ID NO: 1605 - DNA, 20 bp, Artificial sequence
  Synthetic oligonucleotide
ttggtaataagagaaaaatt

SEQ ID NO: 1606 - DNA, 20 bp, Artificial sequence
  Synthetic oligonucleotide
aacttgctccatgtttcctc

SEQ ID NO: 1607 - DNA, 20 bp, Artificial sequence
  Synthetic oligonucleotide
tgaaattggaaacttagtgt

SEQ ID NO: 1608 - DNA, 20 bp, Artificial sequence
  Synthetic oligonucleotide
gataaaccccctttttaaca

SEQ ID NO: 1609 - DNA, 20 bp, Artificial sequence
  Synthetic oligonucleotide
ttattatttccctttatttt

SEQ ID NO: 1610 - DNA, 20 bp, Artificial sequence
  Synthetic oligonucleotide
tctataatgctattctgagt

SEQ ID NO: 1611 - DNA, 20 bp, Artificial sequence
  Synthetic oligonucleotide
taacatgcaaaagaatgaaa

SEQ ID NO: 1612 - DNA, 20 bp, Artificial sequence
  Synthetic oligonucleotide
gattaacggttgcttagggt

SEQ ID NO: 1613 - DNA, 20 bp, Artificial sequence
  Synthetic oligonucleotide
aggacaattcagagtccagt

SEQ ID NO: 1614 - DNA, 20 bp, Artificial sequence
  Synthetic oligonucleotide
gaatatagcactctgctgta

SEQ ID NO: 1615 - DNA, 20 bp, Artificial sequence
  Synthetic oligonucleotide
gagatagcagaatggttacc

SEQ ID NO: 1616 - DNA, 20 bp, Artificial sequence
  Synthetic oligonucleotide
aaaaaagtggaaaaacttca

SEQ ID NO: 1617 - DNA, 20 bp, Artificial sequence
  Synthetic oligonucleotide
aggctggtaacagagcatga

SEQ ID NO: 1618 - DNA, 20 bp, Artificial sequence
  Synthetic oligonucleotide
aaaattaggtaagcgatcac

SEQ ID NO: 1619 - DNA, 20 bp, Artificial sequence
  Synthetic oligonucleotide
taaataaaggaaacaattat

SEQ ID NO: 1620 - DNA, 20 bp, Artificial sequence
  Synthetic oligonucleotide
gtgttcagtatagattatcc

SEQ ID NO: 1621 - DNA, 20 bp, Artificial sequence
  Synthetic oligonucleotide
tccctgcagcctggaccttc

SEQ ID NO: 1622 - DNA, 20 bp, Artificial sequence
  Synthetic oligonucleotide
aaatcataggagttttatag

SEQ ID NO: 1623 - DNA, 20 bp, Artificial sequence
  Synthetic oligonucleotide
caaagatcaatacaacaaaa

SEQ ID NO: 1624 - DNA, 20 bp, Artificial sequence
  Synthetic oligonucleotide
ttaaatatcaacacagggat

SEQ ID NO: 1625 - DNA, 20 bp, Artificial sequence
  Synthetic oligonucleotide
atttgggagagctagttaca

SEQ ID NO: 1626 - DNA, 20 bp, Artificial sequence
  Synthetic oligonucleotide
tagttaaagcaggaaagaga

SEQ ID NO: 1627 - DNA, 20 bp, Artificial sequence
  Synthetic oligonucleotide
aaacaatcataatgaacttt

SEQ ID NO: 1628 - DNA, 20 bp, Artificial sequence
  Synthetic oligonucleotide
aaaatgttaaaaggcagttg

SEQ ID NO: 1629 - DNA, 20 bp, Artificial sequence
  Synthetic oligonucleotide
ccacctccagggttcatgga

SEQ ID NO: 1630 - DNA, 20 bp, Artificial sequence
  Synthetic oligonucleotide
taatctatagctaatttgca

SEQ ID NO: 1631 - DNA, 20 bp, Artificial sequence
  Synthetic oligonucleotide
ttaggctaggcacatggagc

SEQ ID NO: 1632 - DNA, 20 bp, Artificial sequence
  Synthetic oligonucleotide
atttgatttttcattactgc

SEQ ID NO: 1633 - DNA, 20 bp, Artificial sequence
  Synthetic oligonucleotide
caatcccctgggccctggag

SEQ ID NO: 1634 - DNA, 20 bp, Artificial sequence
  Synthetic oligonucleotide
ccaaatcctgtataccatca

SEQ ID NO: 1635 - DNA, 20 bp, Artificial sequence
  Synthetic oligonucleotide
ccaccgcgggactccgagga

SEQ ID NO: 1636 - DNA, 20 bp, Artificial sequence
  Synthetic oligonucleotide
gttgctaccaaaacagtctg

SEQ ID NO: 1637 - DNA, 20 bp, Artificial sequence
  Synthetic oligonucleotide
tacttttctcatgtgcggca

SEQ ID NO: 1638 - DNA, 20 bp, Artificial sequence
  Synthetic oligonucleotide
tcctatcatcattttccagg

SEQ ID NO: 1639 - DNA, 20 bp, Artificial sequence
  Synthetic oligonucleotide
ctgaaccagaattcgggttg

SEQ ID NO: 1640 - DNA, 20 bp, Artificial sequence
  Synthetic oligonucleotide
gaagctaggtgatgtttcat

SEQ ID NO: 1641 - DNA, 20 bp, Artificial sequence
  Synthetic oligonucleotide
ctggaagtctgaaccccttg

SEQ ID NO: 1642 - DNA, 20 bp, Artificial sequence
  Synthetic oligonucleotide
atcattggcgcatgggcagt

SEQ ID NO: 1643 - DNA, 20 bp, Artificial sequence
  Synthetic oligonucleotide
ttacaagaaatcaacatata

SEQ ID NO: 1644 - DNA, 20 bp, Artificial sequence
  Synthetic oligonucleotide
gttattaaaaaataaataac

SEQ ID NO: 1645 - DNA, 20 bp, Artificial sequence
  Synthetic oligonucleotide
taatccgtcagtttgacggt

SEQ ID NO: 1646 - DNA, 20 bp, Artificial sequence
  Synthetic oligonucleotide
tttttttcagtttttaaaac

SEQ ID NO: 1647 - DNA, 20 bp, Artificial sequence
  Synthetic oligonucleotide
ccaccccttcccttccccag

SEQ ID NO: 1648 - DNA, 20 bp, Artificial sequence
  Synthetic oligonucleotide
cgctagtaaacacccgcctt

SEQ ID NO: 1649 - DNA, 20 bp, Artificial sequence
  Synthetic oligonucleotide
cctgtatcccaagcaattct

SEQ ID NO: 1650 - DNA, 20 bp, Artificial sequence
  Synthetic oligonucleotide
ttacatctccgttgaagttg

SEQ ID NO: 1651 - DNA, 20 bp, Artificial sequence
  Synthetic oligonucleotide
atgagaatcatttgaacgca

SEQ ID NO: 1652 - DNA, 20 bp, Artificial sequence
  Synthetic oligonucleotide
tttctgtttttcagtagaga

SEQ ID NO: 1653 - DNA, 20 bp, Artificial sequence
  Synthetic oligonucleotide
tagactggagttgccagata

SEQ ID NO: 1654 - DNA, 20 bp, Artificial sequence
  Synthetic oligonucleotide
cgtctggtccctgttcaaca

SEQ ID NO: 1655 - DNA, 20 bp, Artificial sequence
  Synthetic oligonucleotide
atcaccgaaaaaatttctca

SEQ ID NO: 1656 - DNA, 20 bp, Artificial sequence
  Synthetic oligonucleotide
ctaaattccctgaattccgt

SEQ ID NO: 1657 - DNA, 20 bp, Artificial sequence
  Synthetic oligonucleotide
atagtaagctactactgaat

SEQ ID NO: 1658 - DNA, 20 bp, Artificial sequence
  Synthetic oligonucleotide
tacagttccagttacttggg

SEQ ID NO: 1659 - DNA, 20 bp, Artificial sequence
  Synthetic oligonucleotide
tataatcaaaatatttcatt

SEQ ID NO: 1660 - DNA, 20 bp, Artificial sequence
  Synthetic oligonucleotide
cgtattttactagtgtacat

SEQ ID NO: 1661 - DNA, 20 bp, Artificial sequence
  Synthetic oligonucleotide
ttaattggagactataagtg

SEQ ID NO: 1662 - DNA, 20 bp, Artificial sequence
  Synthetic oligonucleotide
acccactggaaaaagaagta

SEQ ID NO: 1663 - DNA, 20 bp, Artificial sequence
  Synthetic oligonucleotide
taaatcaaacaagaatggta

SEQ ID NO: 1664 - DNA, 20 bp, Artificial sequence
  Synthetic oligonucleotide
tagaagagtactcttaacat

SEQ ID NO: 1665 - DNA, 20 bp, Artificial sequence
  Synthetic oligonucleotide
ttaaacagtcaagttatcta

SEQ ID NO: 1666 - DNA, 20 bp, Artificial sequence
  Synthetic oligonucleotide
aatggtgttttgactaaaca

SEQ ID NO: 1667 - DNA, 20 bp, Artificial sequence
  Synthetic oligonucleotide
cacctctttttgcataactg

SEQ ID NO: 1668 - DNA, 20 bp, Artificial sequence
  Synthetic oligonucleotide
atactacgcactggacgcaa

SEQ ID NO: 1669 - DNA, 20 bp, Artificial sequence
  Synthetic oligonucleotide
atcaagtaaaaaacaagcag

SEQ ID NO: 1670 - DNA, 20 bp, Artificial sequence
  Synthetic oligonucleotide
catggtataagggcaatgat

SEQ ID NO: 1671 - DNA, 20 bp, Artificial sequence
  Synthetic oligonucleotide
catgtcctatgcttattttt

SEQ ID NO: 1672 - DNA, 20 bp, Artificial sequence
  Synthetic oligonucleotide
aattccaattcttacagctg

SEQ ID NO: 1673 - DNA, 20 bp, Artificial sequence
  Synthetic oligonucleotide
agtgagataaaatagaaaaa

SEQ ID NO: 1674 - DNA, 20 bp, Artificial sequence
  Synthetic oligonucleotide
gatgatctaataaaagcaat

SEQ ID NO: 1675 - DNA, 20 bp, Artificial sequence
  Synthetic oligonucleotide
ataaatactgctaatactac

SEQ ID NO: 1676 - DNA, 20 bp, Artificial sequence
  Synthetic oligonucleotide
ctgatctaggccttcaagaa

SEQ ID NO: 1677 - DNA, 20 bp, Artificial sequence
  Synthetic oligonucleotide
tgttggtagtaaatagtaca

SEQ ID NO: 1678 - DNA, 20 bp, Artificial sequence
  Synthetic oligonucleotide
tctgctgatctggctctgct

SEQ ID NO: 1679 - DNA, 20 bp, Artificial sequence
  Synthetic oligonucleotide
ctctaggtgaagtcaacaat

SEQ ID NO: 1680 - DNA, 20 bp, Artificial sequence
  Synthetic oligonucleotide
agtaaaaagtaaatgtcttc

SEQ ID NO: 1681 - DNA, 20 bp, Artificial sequence
  Synthetic oligonucleotide
acagcgagattccctctcaa

SEQ ID NO: 1682 - DNA, 20 bp, Artificial sequence
  Synthetic oligonucleotide
aacggagtcactgtttttcc

SEQ ID NO: 1683 - DNA, 20 bp, Artificial sequence
  Synthetic oligonucleotide
tttggagaggaattctggag

SEQ ID NO: 1684 - DNA, 20 bp, Artificial sequence
  Synthetic oligonucleotide
caggcagagataaaccccct

SEQ ID NO: 1685 - DNA, 20 bp, Artificial sequence
  Synthetic oligonucleotide
atttttaacatatacatact

SEQ ID NO: 1686 - DNA, 20 bp, Artificial sequence
  Synthetic oligonucleotide
aatctataatgctattctga

SEQ ID NO: 1687 - DNA, 20 bp, Artificial sequence
  Synthetic oligonucleotide
cctttaattcagctactttt

SEQ ID NO: 1688 - DNA, 20 bp, Artificial sequence
  Synthetic oligonucleotide
agcccatccatagagacaga

SEQ ID NO: 1689 - DNA, 20 bp, Artificial sequence
  Synthetic oligonucleotide
ggataagacatagagattca

SEQ ID NO: 1690 - DNA, 20 bp, Artificial sequence
  Synthetic oligonucleotide
ttctaatgctatattgctat

SEQ ID NO: 1691 - DNA, 20 bp, Artificial sequence
  Synthetic oligonucleotide
tacggcactatatacacaac

SEQ ID NO: 1692 - DNA, 20 bp, Artificial sequence
  Synthetic oligonucleotide
tacagtaaaagcaacaataa

SEQ ID NO: 1693 - DNA, 20 bp, Artificial sequence
  Synthetic oligonucleotide
tcaccctgaggtcaggagct

SEQ ID NO: 1694 - DNA, 20 bp, Artificial sequence
  Synthetic oligonucleotide
caactatccacacaagaaag

SEQ ID NO: 1695 - DNA, 20 bp, Artificial sequence
  Synthetic oligonucleotide
cttggctgtaactaaataaa

SEQ ID NO: 1696 - DNA, 20 bp, Artificial sequence
  Synthetic oligonucleotide
ttatttataatacctaaaac

SEQ ID NO: 1697 - DNA, 20 bp, Artificial sequence
  Synthetic oligonucleotide
ctccctaattttaatgcaga

SEQ ID NO: 1698 - DNA, 20 bp, Artificial sequence
  Synthetic oligonucleotide
ctcatctcatacacaaaaat

SEQ ID NO: 1699 - DNA, 20 bp, Artificial sequence
  Synthetic oligonucleotide
tatttctcccagaactgata

SEQ ID NO: 1700 - DNA, 20 bp, Artificial sequence
  Synthetic oligonucleotide
ctcactgactactcctatca

SEQ ID NO: 1701 - DNA, 20 bp, Artificial sequence
  Synthetic oligonucleotide
aagaactgattatataatta

SEQ ID NO: 1702 - DNA, 20 bp, Artificial sequence
  Synthetic oligonucleotide
aagtagtgaagcaaaatgtt

SEQ ID NO: 1703 - DNA, 20 bp, Artificial sequence
  Synthetic oligonucleotide
atgttctttccacttgttaa

SEQ ID NO: 1704 - DNA, 20 bp, Artificial sequence
  Synthetic oligonucleotide
acatgaatattatttcttat

SEQ ID NO: 1705 - DNA, 20 bp, Artificial sequence
  Synthetic oligonucleotide
ccttatttttattttttatt

SEQ ID NO: 1706 - DNA, 20 bp, Artificial sequence
  Synthetic oligonucleotide
atttaaagactataatacgg

SEQ ID NO: 1707 - DNA, 20 bp, Artificial sequence
  Synthetic oligonucleotide
ggtaggcaaggctgccgagt

SEQ ID NO: 1708 - DNA, 20 bp, Artificial sequence
  Synthetic oligonucleotide
tactgccccagggaactgat

SEQ ID NO: 1709 - DNA, 20 bp, Artificial sequence
  Synthetic oligonucleotide
aaagcaaatcaactgcagtg

SEQ ID NO: 1710 - DNA, 20 bp, Artificial sequence
  Synthetic oligonucleotide
gaaggccaactgagtcctag

SEQ ID NO: 1711 - DNA, 20 bp, Artificial sequence
  Synthetic oligonucleotide
catcattggcgcatgggcag

SEQ ID NO: 1712 - DNA, 20 bp, Artificial sequence
  Synthetic oligonucleotide
ggtggccaccgcgggactcc

SEQ ID NO: 1713 - DNA, 20 bp, Artificial sequence
  Synthetic oligonucleotide
ccgccgccgttgccgttgct

SEQ ID NO: 1714 - DNA, 20 bp, Artificial sequence
  Synthetic oligonucleotide
gtacttttctcatgtgcggc

SEQ ID NO: 1715 - DNA, 20 bp, Artificial sequence
  Synthetic oligonucleotide
ctcctatcatcattttccag

SEQ ID NO: 1716 - DNA, 20 bp, Artificial sequence
  Synthetic oligonucleotide
tctgaaccagaattcgggtt

SEQ ID NO: 1717 - DNA, 20 bp, Artificial sequence
  Synthetic oligonucleotide
gcacttggttcaattttgtc

SEQ ID NO: 1718 - DNA, 20 bp, Artificial sequence
  Synthetic oligonucleotide
gctggaagtctgaacccctt

SEQ ID NO: 1719 - DNA, 20 bp, Artificial sequence
  Synthetic oligonucleotide
ggatgttacaagaaatcaac

SEQ ID NO: 1720 - DNA, 20 bp, Artificial sequence
  Synthetic oligonucleotide
caagggttattaaaaaataa

SEQ ID NO: 1721 - DNA, 20 bp, Artificial sequence
  Synthetic oligonucleotide
aataataatccgtcagtttg

SEQ ID NO: 1722 - DNA, 20 bp, Artificial sequence
  Synthetic oligonucleotide
actccccaccccttcccttc

SEQ ID NO: 1723 - DNA, 20 bp, Artificial sequence
  Synthetic oligonucleotide
cccccagcccctactacaac

SEQ ID NO: 1724 - DNA, 20 bp, Artificial sequence
  Synthetic oligonucleotide
atcactaaaagaaaaatatt

SEQ ID NO: 1725 - DNA, 20 bp, Artificial sequence
  Synthetic oligonucleotide
ataaactgtttacatctccg

SEQ ID NO: 1726 - DNA, 20 bp, Artificial sequence
  Synthetic oligonucleotide
aaggccatcctgggcaacag

SEQ ID NO: 1727 - DNA, 20 bp, Artificial sequence
  Synthetic oligonucleotide
gagtctcactctgctctgtg

SEQ ID NO: 1728 - DNA, 20 bp, Artificial sequence
  Synthetic oligonucleotide
aaaacagtgaaccatgattc

SEQ ID NO: 1729 - DNA, 20 bp, Artificial sequence
  Synthetic oligonucleotide
tgctcccccaatgtccaccg

SEQ ID NO: 1730 - DNA, 20 bp, Artificial sequence
  Synthetic oligonucleotide
ttatgttacatctgccaaca

SEQ ID NO: 1731 - DNA, 20 bp, Artificial sequence
  Synthetic oligonucleotide
ttttctgaaatgttttatat

SEQ ID NO: 1732 - DNA, 20 bp, Artificial sequence
  Synthetic oligonucleotide
aatctttttattcttgtaat

SEQ ID NO: 1733 - DNA, 20 bp, Artificial sequence
  Synthetic oligonucleotide
agaaagttttaaaaattagg

SEQ ID NO: 1734 - DNA, 20 bp, Artificial sequence
  Synthetic oligonucleotide
tgtccttcagtagtttctaa

SEQ ID NO: 1735 - DNA, 20 bp, Artificial sequence
  Synthetic oligonucleotide
tttaagtaatgctttatatt

SEQ ID NO: 1736 - DNA, 20 bp, Artificial sequence
  Synthetic oligonucleotide
tgtttaagtaaaatgttttt

SEQ ID NO: 1737 - DNA, 20 bp, Artificial sequence
  Synthetic oligonucleotide
tgaggtatccagagttacta

SEQ ID NO: 1738 - DNA, 20 bp, Artificial sequence
  Synthetic oligonucleotide
aaataataataatacagaag

SEQ ID NO: 1739 - DNA, 20 bp, Artificial sequence
  Synthetic oligonucleotide
cacgactggtcgatccctag

SEQ ID NO: 1740 - DNA, 20 bp, Artificial sequence
  Synthetic oligonucleotide
tcattaaaaaaacacatata

SEQ ID NO: 1741 - DNA, 20 bp, Artificial sequence
  Synthetic oligonucleotide
ctaataacttacaacaactg

SEQ ID NO: 1742 - DNA, 20 bp, Artificial sequence
  Synthetic oligonucleotide
cccacctctttttgcataac

SEQ ID NO: 1743 - DNA, 20 bp, Artificial sequence
  Synthetic oligonucleotide
tatagaagagggcaatttct

SEQ ID NO: 1744 - DNA, 20 bp, Artificial sequence
  Synthetic oligonucleotide
gaaggaaaaaaatagaggag

SEQ ID NO: 1745 - DNA, 20 bp, Artificial sequence
  Synthetic oligonucleotide
aataataaagacagtatcac

SEQ ID NO: 1746 - DNA, 20 bp, Artificial sequence
  Synthetic oligonucleotide
aataattccattcaaagtat

SEQ ID NO: 1747 - DNA, 20 bp, Artificial sequence
  Synthetic oligonucleotide
taaaatgaaattaattccaa

SEQ ID NO: 1748 - DNA, 20 bp, Artificial sequence
  Synthetic oligonucleotide
gataaagtgagataaaatag

SEQ ID NO: 1749 - DNA, 20 bp, Artificial sequence
  Synthetic oligonucleotide
taaatccaggagtaaaagaa

SEQ ID NO: 1750 - DNA, 20 bp, Artificial sequence
  Synthetic oligonucleotide
actgagttctataggtgctt

SEQ ID NO: 1751 - DNA, 20 bp, Artificial sequence
  Synthetic oligonucleotide
caaagttctaaggaacaaaa

SEQ ID NO: 1752 - DNA, 20 bp, Artificial sequence
  Synthetic oligonucleotide
gcaagatctgggtatccatt

SEQ ID NO: 1753 - DNA, 20 bp, Artificial sequence
  Synthetic oligonucleotide
ctctagttgggagttagact

SEQ ID NO: 1754 - DNA, 20 bp, Artificial sequence
  Synthetic oligonucleotide
ggcttaaaatgtcctacttc

SEQ ID NO: 1755 - DNA, 20 bp, Artificial sequence
  Synthetic oligonucleotide
acatccagtaaaaagtaaat

SEQ ID NO: 1756 - DNA, 20 bp, Artificial sequence
  Synthetic oligonucleotide
atgggcatggtagcacgcgc

SEQ ID NO: 1757 - DNA, 20 bp, Artificial sequence
  Synthetic oligonucleotide
caattagctgcacaaacgga

SEQ ID NO: 1758 - DNA, 20 bp, Artificial sequence
  Synthetic oligonucleotide
cagtgagcaaagaaatttca

SEQ ID NO: 1759 - DNA, 20 bp, Artificial sequence
  Synthetic oligonucleotide
taattatcaggcagagataa

SEQ ID NO: 1760 - DNA, 20 bp, Artificial sequence
  Synthetic oligonucleotide
acactttactcactgcgaaa

SEQ ID NO: 1761 - DNA, 20 bp, Artificial sequence
  Synthetic oligonucleotide
aactgccatttttccaatta

SEQ ID NO: 1762 - DNA, 20 bp, Artificial sequence
  Synthetic oligonucleotide
tgaggaaaggctacctttgc

SEQ ID NO: 1763 - DNA, 20 bp, Artificial sequence
  Synthetic oligonucleotide
gaatttgccccaaataagcc

SEQ ID NO: 1764 - DNA, 20 bp, Artificial sequence
  Synthetic oligonucleotide
gctaactgaaaaagtacagc

SEQ ID NO: 1765 - DNA, 20 bp, Artificial sequence
  Synthetic oligonucleotide
ttgttctaatgctatattgc

SEQ ID NO: 1766 - DNA, 20 bp, Artificial sequence
  Synthetic oligonucleotide
gctggtaacgatgtggataa

SEQ ID NO: 1767 - DNA, 20 bp, Artificial sequence
  Synthetic oligonucleotide
agttaaaatcatatcaacta

SEQ ID NO: 1768 - DNA, 20 bp, Artificial sequence
  Synthetic oligonucleotide
aaagtggaaaaattcaattg

SEQ ID NO: 1769 - DNA, 20 bp, Artificial sequence
  Synthetic oligonucleotide
ttgaacaactatccacacaa

SEQ ID NO: 1770 - DNA, 20 bp, Artificial sequence
  Synthetic oligonucleotide
taagggcaatgtataaagta

SEQ ID NO: 1771 - DNA, 20 bp, Artificial sequence
  Synthetic oligonucleotide
gttacagtaccctgtgaaga

SEQ ID NO: 1772 - DNA, 20 bp, Artificial sequence
  Synthetic oligonucleotide
aaaatgaaaactttatgtca

SEQ ID NO: 1773 - DNA, 20 bp, Artificial sequence
  Synthetic oligonucleotide
cctggaccactactctcatc

SEQ ID NO: 1774 - DNA, 20 bp, Artificial sequence
  Synthetic oligonucleotide
agcaggcacaaaactgatac

SEQ ID NO: 1775 - DNA, 20 bp, Artificial sequence
  Synthetic oligonucleotide
acacaccaaaaaaattaagg

SEQ ID NO: 1776 - DNA, 20 bp, Artificial sequence
  Synthetic oligonucleotide
agaacttgttcataaaatcc

SEQ ID NO: 1777 - DNA, 20 bp, Artificial sequence
  Synthetic oligonucleotide
ccctcagatcaagtagtgaa

SEQ ID NO: 1778 - DNA, 20 bp, Artificial sequence
  Synthetic oligonucleotide
gcaatggaaattttagctta

SEQ ID NO: 1779 - DNA, 20 bp, Artificial sequence
  Synthetic oligonucleotide
atctagtaatggatccaaaa

SEQ ID NO: 1780 - DNA, 20 bp, Artificial sequence
  Synthetic oligonucleotide
aatccttaatatcctctaga

SEQ ID NO: 1781 - DNA, 20 bp, Artificial sequence
  Synthetic oligonucleotide
tgaaatatttttactatgca

SEQ ID NO: 1782 - DNA, 20 bp, Artificial sequence
  Synthetic oligonucleotide
attccaaaatagttccccac

SEQ ID NO: 1783 - DNA, 20 bp, Artificial sequence
  Synthetic oligonucleotide
taaagtcaaaaaagactact

SEQ ID NO: 1784 - DNA, 20 bp, Artificial sequence
  Synthetic oligonucleotide
ctcttatgaagctgactcca

SEQ ID NO: 1785 - DNA, 20 bp, Artificial sequence
  Synthetic oligonucleotide
tacactcaaagccagtccat

SEQ ID NO: 1786 - DNA, 20 bp, Artificial sequence
  Synthetic oligonucleotide
gactcggtggccaccgcggg

SEQ ID NO: 1787 - DNA, 20 bp, Artificial sequence
  Synthetic oligonucleotide
acgcgccgccgccgttgccg

SEQ ID NO: 1788 - DNA, 20 bp, Artificial sequence
  Synthetic oligonucleotide
ctgtacttttctcatgtgcg

SEQ ID NO: 1789 - DNA, 20 bp, Artificial sequence
  Synthetic oligonucleotide
actcctatcatcattttcca

SEQ ID NO: 1790 - DNA, 20 bp, Artificial sequence
  Synthetic oligonucleotide
ggtctgaaccagaattcggg

SEQ ID NO: 1791 - DNA, 20 bp, Artificial sequence
  Synthetic oligonucleotide
tagcacttggttcaattttg

SEQ ID NO: 1792 - DNA, 20 bp, Artificial sequence
  Synthetic oligonucleotide
gggctggaagtctgaacccc

SEQ ID NO: 1793 - DNA, 20 bp, Artificial sequence
  Synthetic oligonucleotide
agcatcattggcgcatgggc

SEQ ID NO: 1794 - DNA, 20 bp, Artificial sequence
  Synthetic oligonucleotide
ttagcattcctattggatgt

SEQ ID NO: 1795 - DNA, 20 bp, Artificial sequence
  Synthetic oligonucleotide
actttcaagggttattaaaa

SEQ ID NO: 1796 - DNA, 20 bp, Artificial sequence
  Synthetic oligonucleotide
cttgatttataaataataat

SEQ ID NO: 1797 - DNA, 20 bp, Artificial sequence
  Synthetic oligonucleotide
cgggcactccccaccccttc

SEQ ID NO: 1798 - DNA, 20 bp, Artificial sequence
  Synthetic oligonucleotide
cgtttccttctccctttgaa

SEQ ID NO: 1799 - DNA, 20 bp, Artificial sequence
  Synthetic oligonucleotide
taggcccttctacaagatat

SEQ ID NO: 1800 - DNA, 20 bp, Artificial sequence
  Synthetic oligonucleotide
tggtggtgtgcgcatgtaga

SEQ ID NO: 1801 - DNA, 20 bp, Artificial sequence
  Synthetic oligonucleotide
aattcaaggccatcctgggc

SEQ ID NO: 1802 - DNA, 20 bp, Artificial sequence
  Synthetic oligonucleotide
tcttccaaactttttttttt

SEQ ID NO: 1803 - DNA, 20 bp, Artificial sequence
  Synthetic oligonucleotide
gaagagtgaaccatggccag

SEQ ID NO: 1804 - DNA, 20 bp, Artificial sequence
  Synthetic oligonucleotide
agcaacccgaccacagctgg

SEQ ID NO: 1805 - DNA, 20 bp, Artificial sequence
  Synthetic oligonucleotide
gctgtatttttactcacctt

SEQ ID NO: 1806 - DNA, 20 bp, Artificial sequence
  Synthetic oligonucleotide
aatgttcatcttttcacatc

SEQ ID NO: 1807 - DNA, 20 bp, Artificial sequence
  Synthetic oligonucleotide
tcataatctcaaatgcaagc

SEQ ID NO: 1808 - DNA, 20 bp, Artificial sequence
  Synthetic oligonucleotide
ctgggaggccaaggtgagtc

SEQ ID NO: 1809 - DNA, 20 bp, Artificial sequence
  Synthetic oligonucleotide
ataattatagagcttcatgt

SEQ ID NO: 1810 - DNA, 20 bp, Artificial sequence
  Synthetic oligonucleotide
aactgctggatagcattaaa

SEQ ID NO: 1811 - DNA, 20 bp, Artificial sequence
  Synthetic oligonucleotide
taaaagtctaaaattatgtt

SEQ ID NO: 1812 - DNA, 20 bp, Artificial sequence
  Synthetic oligonucleotide
gggaagaaggatagaacact

SEQ ID NO: 1813 - DNA, 20 bp, Artificial sequence
  Synthetic oligonucleotide
gcattggtgacagagcaaaa

SEQ ID NO: 1814 - DNA, 20 bp, Artificial sequence
  Synthetic oligonucleotide
attcagatccaaaaagtcta

SEQ ID NO: 1815 - DNA, 20 bp, Artificial sequence
  Synthetic oligonucleotide
tgtacattttatacagagtc

SEQ ID NO: 1816 - DNA, 20 bp, Artificial sequence
  Synthetic oligonucleotide
gcagtttatccccaataatc

SEQ ID NO: 1817 - DNA, 20 bp, Artificial sequence
  Synthetic oligonucleotide
atctttgcttgaataaatct

SEQ ID NO: 1818 - DNA, 20 bp, Artificial sequence
  Synthetic oligonucleotide
cttttatagaagagggcaat

SEQ ID NO: 1819 - DNA, 20 bp, Artificial sequence
  Synthetic oligonucleotide
aaatgaaggaaaaaaataga

SEQ ID NO: 1820 - DNA, 20 bp, Artificial sequence
  Synthetic oligonucleotide
ataaataataaagacagtat

SEQ ID NO: 1821 - DNA, 20 bp, Artificial sequence
  Synthetic oligonucleotide
tctttagagatttatttgag

SEQ ID NO: 1822 - DNA, 20 bp, Artificial sequence
  Synthetic oligonucleotide
tcaaacctatggcaaaagtg

SEQ ID NO: 1823 - DNA, 20 bp, Artificial sequence
  Synthetic oligonucleotide
ttatggtgagctacgatggc

SEQ ID NO: 1824 - DNA, 20 bp, Artificial sequence
  Synthetic oligonucleotide
gtgggcttggttttgaaaaa

SEQ ID NO: 1825 - DNA, 20 bp, Artificial sequence
  Synthetic oligonucleotide
aataataatttgagataccc

SEQ ID NO: 1826 - DNA, 20 bp, Artificial sequence
  Synthetic oligonucleotide
cttttagaatcgaatacaat

SEQ ID NO: 1827 - DNA, 20 bp, Artificial sequence
  Synthetic oligonucleotide
cattgcatcattagctagaa

SEQ ID NO: 1828 - DNA, 20 bp, Artificial sequence
  Synthetic oligonucleotide
gcacaggaaattttctctag

SEQ ID NO: 1829 - DNA, 20 bp, Artificial sequence
  Synthetic oligonucleotide
caaccttttcttcagacaag

SEQ ID NO: 1830 - DNA, 20 bp, Artificial sequence
  Synthetic oligonucleotide
ttacttaagtaatgtatgcc

SEQ ID NO: 1831 - DNA, 20 bp, Artificial sequence
  Synthetic oligonucleotide
ttctgttaccttttctccag

SEQ ID NO: 1832 - DNA, 20 bp, Artificial sequence
  Synthetic oligonucleotide
acctcaaactgaaccgccag

SEQ ID NO: 1833 - DNA, 20 bp, Artificial sequence
  Synthetic oligonucleotide
gtatcatatatttctcagcc

SEQ ID NO: 1834 - DNA, 20 bp, Artificial sequence
  Synthetic oligonucleotide
aaagaagcataattatcagg

SEQ ID NO: 1835 - DNA, 20 bp, Artificial sequence
  Synthetic oligonucleotide
ttaacactttactcactgcg

SEQ ID NO: 1836 - DNA, 20 bp, Artificial sequence
  Synthetic oligonucleotide
gtttgtatcccatatgactt

SEQ ID NO: 1837 - DNA, 20 bp, Artificial sequence
  Synthetic oligonucleotide
aaagctaaaacacaggctga

SEQ ID NO: 1838 - DNA, 20 bp, Artificial sequence
  Synthetic oligonucleotide
tcaaggaatattagtcagtc

SEQ ID NO: 1839 - DNA, 20 bp, Artificial sequence
  Synthetic oligonucleotide
aagactttttatgttgctcc

SEQ ID NO: 1840 - DNA, 20 bp, Artificial sequence
  Synthetic oligonucleotide
tattgccatcttacaaatag

SEQ ID NO: 1841 - DNA, 20 bp, Artificial sequence
  Synthetic oligonucleotide
tggtggcaggaggcaggaga

SEQ ID NO: 1842 - DNA, 20 bp, Artificial sequence
  Synthetic oligonucleotide
atgtgacggcatgtgcctgt

SEQ ID NO: 1843 - DNA, 20 bp, Artificial sequence
  Synthetic oligonucleotide
tcccaaagtggaaaaattca

SEQ ID NO: 1844 - DNA, 20 bp, Artificial sequence
  Synthetic oligonucleotide
gccaaacagaaccttccagt

SEQ ID NO: 1845 - DNA, 20 bp, Artificial sequence
  Synthetic oligonucleotide
cttgtttttctagccctggg

SEQ ID NO: 1846 - DNA, 20 bp, Artificial sequence
  Synthetic oligonucleotide
cagctatttttaagaaactg

SEQ ID NO: 1847 - DNA, 20 bp, Artificial sequence
  Synthetic oligonucleotide
ttccaaggctaaaaaaaaaa

SEQ ID NO: 1848 - DNA, 20 bp, Artificial sequence
  Synthetic oligonucleotide
ggacaacggatatccacaag

SEQ ID NO: 1849 - DNA, 20 bp, Artificial sequence
  Synthetic oligonucleotide
ttaaaatataactcacaaca

SEQ ID NO: 1850 - DNA, 20 bp, Artificial sequence
  Synthetic oligonucleotide
atcatcaatggctgctaaaa

SEQ ID NO: 1851 - DNA, 20 bp, Artificial sequence
  Synthetic oligonucleotide
gaatgactgcttacaactag

SEQ ID NO: 1852 - DNA, 20 bp, Artificial sequence
  Synthetic oligonucleotide
tgtaatgccagtgaccctca

SEQ ID NO: 1853 - DNA, 20 bp, Artificial sequence
  Synthetic oligonucleotide
tgaaaatcatctgtacctca

SEQ ID NO: 1854 - DNA, 20 bp, Artificial sequence
  Synthetic oligonucleotide
gtaccaaaataaaactattt

SEQ ID NO: 1855 - DNA, 20 bp, Artificial sequence
  Synthetic oligonucleotide
tttcctagcaccaaataaat

SEQ ID NO: 1856 - DNA, 20 bp, Artificial sequence
  Synthetic oligonucleotide
tttgaaatttcacttttaaa

SEQ ID NO: 1857 - DNA, 20 bp, Artificial sequence
  Synthetic oligonucleotide
agcccatacacagaaatgat

SEQ ID NO: 1858 - DNA, 20 bp, Artificial sequence
  Synthetic oligonucleotide
atacatactaaagtcaaaaa

SEQ ID NO: 1859 - DNA, 20 bp, Artificial sequence
  Synthetic oligonucleotide
tacatgtaagttcacatgcc

SEQ ID NO: 1860 - DNA, 20 bp, Artificial sequence
  Synthetic oligonucleotide
attcgcttttccccctccca

SEQ ID NO: 1861 - DNA, 20 bp, Artificial sequence
  Synthetic oligonucleotide
ttctgtacttttctcatgtg

SEQ ID NO: 1862 - DNA, 20 bp, Artificial sequence
  Synthetic oligonucleotide
ggcgagactcggtggccacc

SEQ ID NO: 1863 - DNA, 20 bp, Artificial sequence
  Synthetic oligonucleotide
ccgaaacgcgccgccgccgt

SEQ ID NO: 1864 - DNA, 20 bp, Artificial sequence
  Synthetic oligonucleotide
tttttcttcctcactcctat

SEQ ID NO: 1865 - DNA, 20 bp, Artificial sequence
  Synthetic oligonucleotide
gccagggaacacctccatta

SEQ ID NO: 1866 - DNA, 20 bp, Artificial sequence
  Synthetic oligonucleotide
ttagcacttggttcaatttt

SEQ ID NO: 1867 - DNA, 20 bp, Artificial sequence
  Synthetic oligonucleotide
tgggctggaagtctgaaccc

SEQ ID NO: 1868 - DNA, 20 bp, Artificial sequence
  Synthetic oligonucleotide
tagcatcattggcgcatggg

SEQ ID NO: 1869 - DNA, 20 bp, Artificial sequence
  Synthetic oligonucleotide
aactgttagcattcctattg

SEQ ID NO: 1870 - DNA, 20 bp, Artificial sequence
  Synthetic oligonucleotide
tcatgactttcaagggttat

SEQ ID NO: 1871 - DNA, 20 bp, Artificial sequence
  Synthetic oligonucleotide
tcaaacttgatttataaata

SEQ ID NO: 1872 - DNA, 20 bp, Artificial sequence
  Synthetic oligonucleotide
aaggaggaaggccgggacgg

SEQ ID NO: 1873 - DNA, 20 bp, Artificial sequence
  Synthetic oligonucleotide
tggtaagctctggcggcact

SEQ ID NO: 1874 - DNA, 20 bp, Artificial sequence
  Synthetic oligonucleotide
ttaggcccttctacaagata

SEQ ID NO: 1875 - DNA, 20 bp, Artificial sequence
  Synthetic oligonucleotide
aaaaacacaagtactttcat

SEQ ID NO: 1876 - DNA, 20 bp, Artificial sequence
  Synthetic oligonucleotide
aagatcctgcaacacacaca

SEQ ID NO: 1877 - DNA, 20 bp, Artificial sequence
  Synthetic oligonucleotide
cagtcttccaaacttttttt

SEQ ID NO: 1878 - DNA, 20 bp, Artificial sequence
  Synthetic oligonucleotide
catagagcttaaattttagt

SEQ ID NO: 1879 - DNA, 20 bp, Artificial sequence
  Synthetic oligonucleotide
ccccagcaacccgaccacag

SEQ ID NO: 1880 - DNA, 20 bp, Artificial sequence
  Synthetic oligonucleotide
actgataaatgactcatccc

SEQ ID NO: 1881 - DNA, 20 bp, Artificial sequence
  Synthetic oligonucleotide
attacctaaataaaatgttc

SEQ ID NO: 1882 - DNA, 20 bp, Artificial sequence
  Synthetic oligonucleotide
taattgtaaagtccctgctc

SEQ ID NO: 1883 - DNA, 20 bp, Artificial sequence
  Synthetic oligonucleotide
aaaaaaggccagtcgcagtg

SEQ ID NO: 1884 - DNA, 20 bp, Artificial sequence
  Synthetic oligonucleotide
caatataattatagagcttc

SEQ ID NO: 1885 - DNA, 20 bp, Artificial sequence
  Synthetic oligonucleotide
gcataagacaccatgcctag

SEQ ID NO: 1886 - DNA, 20 bp, Artificial sequence
  Synthetic oligonucleotide
tcatgtctctcatatgttta

SEQ ID NO: 1887 - DNA, 20 bp, Artificial sequence
  Synthetic oligonucleotide
tagagtgatggtaggcatac

SEQ ID NO: 1888 - DNA, 20 bp, Artificial sequence
  Synthetic oligonucleotide
ccccgctacttggtagggtg

SEQ ID NO: 1889 - DNA, 20 bp, Artificial sequence
  Synthetic oligonucleotide
ttttaataaaataatcacaa

SEQ ID NO: 1890 - DNA, 20 bp, Artificial sequence
  Synthetic oligonucleotide
gcatgagtcaattaaacctc

SEQ ID NO: 1891 - DNA, 20 bp, Artificial sequence
  Synthetic oligonucleotide
ttttaacttcatggaattac

SEQ ID NO: 1892 - DNA, 20 bp, Artificial sequence
  Synthetic oligonucleotide
aaaaaagtttgtaagatcac

SEQ ID NO: 1893 - DNA, 20 bp, Artificial sequence
  Synthetic oligonucleotide
tggttttctccatactgata

SEQ ID NO: 1894 - DNA, 20 bp, Artificial sequence
  Synthetic oligonucleotide
gttggagtaaagaggaaaac

SEQ ID NO: 1895 - DNA, 20 bp, Artificial sequence
  Synthetic oligonucleotide
ggcactgaatttcatttatt

SEQ ID NO: 1896 - DNA, 20 bp, Artificial sequence
  Synthetic oligonucleotide
cggctggagtgcaatctcag

SEQ ID NO: 1897 - DNA, 20 bp, Artificial sequence
  Synthetic oligonucleotide
acagaatttaggaattgaaa

SEQ ID NO: 1898 - DNA, 20 bp, Artificial sequence
  Synthetic oligonucleotide
aaaatgtaaattgattgtag

SEQ ID NO: 1899 - DNA, 20 bp, Artificial sequence
  Synthetic oligonucleotide
aataaaaacaaaccacaatg

SEQ ID NO: 1900 - DNA, 20 bp, Artificial sequence
  Synthetic oligonucleotide
caaaaatatatatacataaa

SEQ ID NO: 1901 - DNA, 20 bp, Artificial sequence
  Synthetic oligonucleotide
atacaattcccagcatttcc

SEQ ID NO: 1902 - DNA, 20 bp, Artificial sequence
  Synthetic oligonucleotide
catcaggatgctgagaaaat

SEQ ID NO: 1903 - DNA, 20 bp, Artificial sequence
  Synthetic oligonucleotide
agtactgacttatgaaagca

SEQ ID NO: 1904 - DNA, 20 bp, Artificial sequence
  Synthetic oligonucleotide
ctttaattccaatgtaacct

SEQ ID NO: 1905 - DNA, 20 bp, Artificial sequence
  Synthetic oligonucleotide
aatcacacttacttatggag

SEQ ID NO: 1906 - DNA, 20 bp, Artificial sequence
  Synthetic oligonucleotide
tttaaagccacagtttatgt

SEQ ID NO: 1907 - DNA, 20 bp, Artificial sequence
  Synthetic oligonucleotide
aatatcggcaatgctgatga

SEQ ID NO: 1908 - DNA, 20 bp, Artificial sequence
  Synthetic oligonucleotide
aagtatcatatatttctcag

SEQ ID NO: 1909 - DNA, 20 bp, Artificial sequence
  Synthetic oligonucleotide
ttcaagactggctgaagaaa

SEQ ID NO: 1910 - DNA, 20 bp, Artificial sequence
  Synthetic oligonucleotide
acaaaactttatagttttac

SEQ ID NO: 1911 - DNA, 20 bp, Artificial sequence
  Synthetic oligonucleotide
ggaatttgctggcaatcaaa

SEQ ID NO: 1912 - DNA, 20 bp, Artificial sequence
  Synthetic oligonucleotide
aataagtcaagaatgaagct

SEQ ID NO: 1913 - DNA, 20 bp, Artificial sequence
  Synthetic oligonucleotide
aaaatgtggtattatccaca

SEQ ID NO: 1914 - DNA, 20 bp, Artificial sequence
  Synthetic oligonucleotide
aggcacctaaaagtagtaag

SEQ ID NO: 1915 - DNA, 20 bp, Artificial sequence
  Synthetic oligonucleotide
acagccctatttgatgtaga

SEQ ID NO: 1916 - DNA, 20 bp, Artificial sequence
  Synthetic oligonucleotide
aatataaaaggcactcaagc

SEQ ID NO: 1917 - DNA, 20 bp, Artificial sequence
  Synthetic oligonucleotide
gccatatgtgacggcatgtg

SEQ ID NO: 1918 - DNA, 20 bp, Artificial sequence
  Synthetic oligonucleotide
cctcaccaaatgaactaaaa

SEQ ID NO: 1919 - DNA, 20 bp, Artificial sequence
  Synthetic oligonucleotide
atattggtcagttagacatt

SEQ ID NO: 1920 - DNA, 20 bp, Artificial sequence
  Synthetic oligonucleotide
acattaactaaaacacagtt

SEQ ID NO: 1921 - DNA, 20 bp, Artificial sequence
  Synthetic oligonucleotide
aacttaaaactttgtcaatt

SEQ ID NO: 1922 - DNA, 20 bp, Artificial sequence
  Synthetic oligonucleotide
ctctataatttgattacatt

SEQ ID NO: 1923 - DNA, 20 bp, Artificial sequence
  Synthetic oligonucleotide
ttttcaacaaatgaggtggg

SEQ ID NO: 1924 - DNA, 20 bp, Artificial sequence
  Synthetic oligonucleotide
tgaaagtttttaaaatataa

SEQ ID NO: 1925 - DNA, 20 bp, Artificial sequence
  Synthetic oligonucleotide
tatcatcaatggctgctaaa

SEQ ID NO: 1926 - DNA, 20 bp, Artificial sequence
  Synthetic oligonucleotide
tttctggtgtggcattaacc

SEQ ID NO: 1927 - DNA, 20 bp, Artificial sequence
  Synthetic oligonucleotide
tgcttattattctcacatat

SEQ ID NO: 1928 - DNA, 20 bp, Artificial sequence
  Synthetic oligonucleotide
gttcattccagatttcactg

SEQ ID NO: 1929 - DNA, 20 bp, Artificial sequence
  Synthetic oligonucleotide
agtaaaaggaataaaatcat

SEQ ID NO: 1930 - DNA, 20 bp, Artificial sequence
  Synthetic oligonucleotide
agagcatctattaaaggatt

SEQ ID NO: 1931 - DNA, 20 bp, Artificial sequence
  Synthetic oligonucleotide
cggaatctcagaggtttttg

SEQ ID NO: 1932 - DNA, 20 bp, Artificial sequence
  Synthetic oligonucleotide
ccctcaagataataagccca

SEQ ID NO: 1933 - DNA, 20 bp, Artificial sequence
  Synthetic oligonucleotide
gtacaggagaatgtacaggg

SEQ ID NO: 1934 - DNA, 20 bp, Artificial sequence
  Synthetic oligonucleotide
aatgccgtttttactctcac

SEQ ID NO: 1935 - DNA, 20 bp, Artificial sequence
  Synthetic oligonucleotide
acaaaactcaaaattgaatt

SEQ ID NO: 1936 - DNA, 20 bp, Artificial sequence
  Synthetic oligonucleotide
gattctgtacttttctcatg

SEQ ID NO: 1937 - DNA, 20 bp, Artificial sequence
  Synthetic oligonucleotide
gaagcggcgagactcggtgg

SEQ ID NO: 1938 - DNA, 20 bp, Artificial sequence
  Synthetic oligonucleotide
ccgggccgaaacgcgccgcc

SEQ ID NO: 1939 - DNA, 20 bp, Artificial sequence
  Synthetic oligonucleotide
atttttcttcctcactccta

SEQ ID NO: 1940 - DNA, 20 bp, Artificial sequence
  Synthetic oligonucleotide
caaattctaggccactggat

SEQ ID NO: 1941 - DNA, 20 bp, Artificial sequence
  Synthetic oligonucleotide
cttagcacttggttcaattt

SEQ ID NO: 1942 - DNA, 20 bp, Artificial sequence
  Synthetic oligonucleotide
ctgggctggaagtctgaacc

SEQ ID NO: 1943 - DNA, 20 bp, Artificial sequence
  Synthetic oligonucleotide
ttagcatcattggcgcatgg

SEQ ID NO: 1944 - DNA, 20 bp, Artificial sequence
  Synthetic oligonucleotide
aagtgaactgttagcattcc

SEQ ID NO: 1945 - DNA, 20 bp, Artificial sequence
  Synthetic oligonucleotide
tgtgttcatgactttcaagg

SEQ ID NO: 1946 - DNA, 20 bp, Artificial sequence
  Synthetic oligonucleotide
cctcatcaaacttgatttat

SEQ ID NO: 1947 - DNA, 20 bp, Artificial sequence
  Synthetic oligonucleotide
cgccggagaggtctggcggg

SEQ ID NO: 1948 - DNA, 20 bp, Artificial sequence
  Synthetic oligonucleotide
aagtagtgtttgggatgctt

SEQ ID NO: 1949 - DNA, 20 bp, Artificial sequence
  Synthetic oligonucleotide
aaaccccatgtacatagatg

SEQ ID NO: 1950 - DNA, 20 bp, Artificial sequence
  Synthetic oligonucleotide
ttcgagatgagcctaaccaa

SEQ ID NO: 1951 - DNA, 20 bp, Artificial sequence
  Synthetic oligonucleotide
tacttaaaatgcataaaaaa

SEQ ID NO: 1952 - DNA, 20 bp, Artificial sequence
  Synthetic oligonucleotide
taagtgaaccacctgcctca

SEQ ID NO: 1953 - DNA, 20 bp, Artificial sequence
  Synthetic oligonucleotide
cctgctttcatagagcttaa

SEQ ID NO: 1954 - DNA, 20 bp, Artificial sequence
  Synthetic oligonucleotide
atttcttcacccgtaaatag

SEQ ID NO: 1955 - DNA, 20 bp, Artificial sequence
  Synthetic oligonucleotide
cattggtcaacagttcacaa

SEQ ID NO: 1956 - DNA, 20 bp, Artificial sequence
  Synthetic oligonucleotide
ctaataggcacacaataaat

SEQ ID NO: 1957 - DNA, 20 bp, Artificial sequence
  Synthetic oligonucleotide
ttattacttgccaggcattg

SEQ ID NO: 1958 - DNA, 20 bp, Artificial sequence
  Synthetic oligonucleotide
tatgttattaagtgtttaat

SEQ ID NO: 1959 - DNA, 20 bp, Artificial sequence
  Synthetic oligonucleotide
ctgtcaccatacaatataat

SEQ ID NO: 1960 - DNA, 20 bp, Artificial sequence
  Synthetic oligonucleotide
ctgctagacaaattctgtaa

SEQ ID NO: 1961 - DNA, 20 bp, Artificial sequence
  Synthetic oligonucleotide
ttattaatttccttattttg

SEQ ID NO: 1962 - DNA, 20 bp, Artificial sequence
  Synthetic oligonucleotide
atgccaaaatcactgtgatt

SEQ ID NO: 1963 - DNA, 20 bp, Artificial sequence
  Synthetic oligonucleotide
gtcaaattaatataaagaaa

SEQ ID NO: 1964 - DNA, 20 bp, Artificial sequence
  Synthetic oligonucleotide
tctcataaacattagtcatg

SEQ ID NO: 1965 - DNA, 20 bp, Artificial sequence
  Synthetic oligonucleotide
cagcacttctctctcctgtc

SEQ ID NO: 1966 - DNA, 20 bp, Artificial sequence
  Synthetic oligonucleotide
aatgaattatattagactgg

SEQ ID NO: 1967 - DNA, 20 bp, Artificial sequence
  Synthetic oligonucleotide
tctttaaaaaaagtttgtaa

SEQ ID NO: 1968 - DNA, 20 bp, Artificial sequence
  Synthetic oligonucleotide
aaaaaaagaaggaaaccatg

SEQ ID NO: 1969 - DNA, 20 bp, Artificial sequence
  Synthetic oligonucleotide
caatggaataaggaaacaga

SEQ ID NO: 1970 - DNA, 20 bp, Artificial sequence
  Synthetic oligonucleotide
ttgtatttctccgtactgtc

SEQ ID NO: 1971 - DNA, 20 bp, Artificial sequence
  Synthetic oligonucleotide
tggagtcacccggctggagt

SEQ ID NO: 1972 - DNA, 20 bp, Artificial sequence
  Synthetic oligonucleotide
aagaatcaaaaaacagaatt

SEQ ID NO: 1973 - DNA, 20 bp, Artificial sequence
  Synthetic oligonucleotide
ttcagggtgatgaaaatgta

SEQ ID NO: 1974 - DNA, 20 bp, Artificial sequence
  Synthetic oligonucleotide
catacaaacataaattaatt

SEQ ID NO: 1975 - DNA, 20 bp, Artificial sequence
  Synthetic oligonucleotide
atctcaaaaatatatataca

SEQ ID NO: 1976 - DNA, 20 bp, Artificial sequence
  Synthetic oligonucleotide
tgcactcataagtctggacg

SEQ ID NO: 1977 - DNA, 20 bp, Artificial sequence
  Synthetic oligonucleotide
tggagagttagcacgaaatg

SEQ ID NO: 1978 - DNA, 20 bp, Artificial sequence
  Synthetic oligonucleotide
taatgttattgaagagtact

SEQ ID NO: 1979 - DNA, 20 bp, Artificial sequence
  Synthetic oligonucleotide
agaaatttatgtaatgcttt

SEQ ID NO: 1980 - DNA, 20 bp, Artificial sequence
  Synthetic oligonucleotide
atgggcaggaaatcacactt

SEQ ID NO: 1981 - DNA, 20 bp, Artificial sequence
  Synthetic oligonucleotide
ctttaaagccacagtttatg

SEQ ID NO: 1982 - DNA, 20 bp, Artificial sequence
  Synthetic oligonucleotide
tcatggctccaatatcggca

SEQ ID NO: 1983 - DNA, 20 bp, Artificial sequence
  Synthetic oligonucleotide
gggttccacacacttaagta

SEQ ID NO: 1984 - DNA, 20 bp, Artificial sequence
  Synthetic oligonucleotide
gtaaaatgaacctaagttca

SEQ ID NO: 1985 - DNA, 20 bp, Artificial sequence
  Synthetic oligonucleotide
tattagagaggtactttaca

SEQ ID NO: 1986 - DNA, 20 bp, Artificial sequence
  Synthetic oligonucleotide
cctctctagcccttaccctt

SEQ ID NO: 1987 - DNA, 20 bp, Artificial sequence
  Synthetic oligonucleotide
agctgaatagatacatgtgc

SEQ ID NO: 1988 - DNA, 20 bp, Artificial sequence
  Synthetic oligonucleotide
acgagaaaaaaactgcacac

SEQ ID NO: 1989 - DNA, 20 bp, Artificial sequence
  Synthetic oligonucleotide
ggctaaataatacatttggt

SEQ ID NO: 1990 - DNA, 20 bp, Artificial sequence
  Synthetic oligonucleotide
ggtctgactccgttgcccag

SEQ ID NO: 1991 - DNA, 20 bp, Artificial sequence
  Synthetic oligonucleotide
ataccccaaaagtacaggca

SEQ ID NO: 1992 - DNA, 20 bp, Artificial sequence
  Synthetic oligonucleotide
aaaatatcagccatatgtga

SEQ ID NO: 1993 - DNA, 20 bp, Artificial sequence
  Synthetic oligonucleotide
cacaagcatcaaggccatct

SEQ ID NO: 1994 - DNA, 20 bp, Artificial sequence
  Synthetic oligonucleotide
ttaggatgtggagggaccgt

SEQ ID NO: 1995 - DNA, 20 bp, Artificial sequence
  Synthetic oligonucleotide
tccatttaattaatatactg

SEQ ID NO: 1996 - DNA, 20 bp, Artificial sequence
  Synthetic oligonucleotide
tgtttcagtaggaacttaaa

SEQ ID NO: 1997 - DNA, 20 bp, Artificial sequence
  Synthetic oligonucleotide
agattaaactctataatttg

SEQ ID NO: 1998 - DNA, 20 bp, Artificial sequence
  Synthetic oligonucleotide
atttgtcaaaactcattaaa

SEQ ID NO: 1999 - DNA, 20 bp, Artificial sequence
  Synthetic oligonucleotide
caacatggtgattagatcat

SEQ ID NO: 2000 - DNA, 20 bp, Artificial sequence
  Synthetic oligonucleotide
agaaatattccaggcaataa

SEQ ID NO: 2001 - DNA, 20 bp, Artificial sequence
  Synthetic oligonucleotide
gaattcagctcaactgtcat

SEQ ID NO: 2002 - DNA, 20 bp, Artificial sequence
  Synthetic oligonucleotide
aagatgggtttttttgctta

SEQ ID NO: 2003 - DNA, 20 bp, Artificial sequence
  Synthetic oligonucleotide
agaaccggctctaatgacta

SEQ ID NO: 2004 - DNA, 20 bp, Artificial sequence
  Synthetic oligonucleotide
ggactaaaccggaagacact

SEQ ID NO: 2005 - DNA, 20 bp, Artificial sequence
  Synthetic oligonucleotide
gtttcccctttaatagtata

SEQ ID NO: 2006 - DNA, 20 bp, Artificial sequence
  Synthetic oligonucleotide
acagtacggaatctcagagg

SEQ ID NO: 2007 - DNA, 20 bp, Artificial sequence
  Synthetic oligonucleotide
gacagcacaccgatgataaa

SEQ ID NO: 2008 - DNA, 20 bp, Artificial sequence
  Synthetic oligonucleotide
ctaagctttgcacacttggg

SEQ ID NO: 2009 - DNA, 20 bp, Artificial sequence
  Synthetic oligonucleotide
gatgaaatgccgtttttact

SEQ ID NO: 2010 - DNA, 20 bp, Artificial sequence
  Synthetic oligonucleotide
agcacatgattgtaaactat

SEQ ID NO: 2011 - DNA, 20 bp, Artificial sequence
  Synthetic oligonucleotide
gcggcgaagcggcgagactc

SEQ ID NO: 2012 - DNA, 20 bp, Artificial sequence
  Synthetic oligonucleotide
aaggagccgccgggagccgg

SEQ ID NO: 2013 - DNA, 20 bp, Artificial sequence
  Synthetic oligonucleotide
cgtttcggccccgaactgga

SEQ ID NO: 2014 - DNA, 20 bp, Artificial sequence
  Synthetic oligonucleotide
tatttttcttcctcactcct

SEQ ID NO: 2015 - DNA, 20 bp, Artificial sequence
  Synthetic oligonucleotide
tacaaattctaggccactgg

SEQ ID NO: 2016 - DNA, 20 bp, Artificial sequence
  Synthetic oligonucleotide
tccttagcacttggttcaat

SEQ ID NO: 2017 - DNA, 20 bp, Artificial sequence
  Synthetic oligonucleotide
tgctgggctggaagtctgaa

SEQ ID NO: 2018 - DNA, 20 bp, Artificial sequence
  Synthetic oligonucleotide
cattagcatcattggcgcat

SEQ ID NO: 2019 - DNA, 20 bp, Artificial sequence
  Synthetic oligonucleotide
actgcaagtgaactgttagc

SEQ ID NO: 2020 - DNA, 20 bp, Artificial sequence
  Synthetic oligonucleotide
gctgatgtgttcatgacttt

SEQ ID NO: 2021 - DNA, 20 bp, Artificial sequence
  Synthetic oligonucleotide
gatcacctcatcaaacttga

SEQ ID NO: 2022 - DNA, 20 bp, Artificial sequence
  Synthetic oligonucleotide
ccgcgcgccggagaggtctg

SEQ ID NO: 2023 - DNA, 20 bp, Artificial sequence
  Synthetic oligonucleotide
aaagggaaactgaagttacc

SEQ ID NO: 2024 - DNA, 20 bp, Artificial sequence
  Synthetic oligonucleotide
cctttaatctgctttcttct

SEQ ID NO: 2025 - DNA, 20 bp, Artificial sequence
  Synthetic oligonucleotide
gtaggctgcgcacggtggct

SEQ ID NO: 2026 - DNA, 20 bp, Artificial sequence
  Synthetic oligonucleotide
aaaccaggccggacgcggtg

SEQ ID NO: 2027 - DNA, 20 bp, Artificial sequence
  Synthetic oligonucleotide
cttgtgtctgttttttagta

SEQ ID NO: 2028 - DNA, 20 bp, Artificial sequence
  Synthetic oligonucleotide
tcctgctttcatagagctta

SEQ ID NO: 2029 - DNA, 20 bp, Artificial sequence
  Synthetic oligonucleotide
cctcttggtctcaatttctt

SEQ ID NO: 2030 - DNA, 20 bp, Artificial sequence
  Synthetic oligonucleotide
ggtcagaggttaaaagtctt

SEQ ID NO: 2031 - DNA, 20 bp, Artificial sequence
  Synthetic oligonucleotide
cttggcacagctctcctgaa

SEQ ID NO: 2032 - DNA, 20 bp, Artificial sequence
  Synthetic oligonucleotide
aagaacagctaaaagttact

SEQ ID NO: 2033 - DNA, 20 bp, Artificial sequence
  Synthetic oligonucleotide
atacagatcgcatagcttaa

SEQ ID NO: 2034 - DNA, 20 bp, Artificial sequence
  Synthetic oligonucleotide
ctattggtactgtcaccata

SEQ ID NO: 2035 - DNA, 20 bp, Artificial sequence
  Synthetic oligonucleotide
atcagtatttactacttctg

SEQ ID NO: 2036 - DNA, 20 bp, Artificial sequence
  Synthetic oligonucleotide
acaattattaatttccttat

SEQ ID NO: 2037 - DNA, 20 bp, Artificial sequence
  Synthetic oligonucleotide
acagtcaggaaaagagacaa

SEQ ID NO: 2038 - DNA, 20 bp, Artificial sequence
  Synthetic oligonucleotide
aaaccaaatattttactatt

SEQ ID NO: 2039 - DNA, 20 bp, Artificial sequence
  Synthetic oligonucleotide
aatgttatatttctcataaa

SEQ ID NO: 2040 - DNA, 20 bp, Artificial sequence
  Synthetic oligonucleotide
gtttcccctacgctgctctc

SEQ ID NO: 2041 - DNA, 20 bp, Artificial sequence
  Synthetic oligonucleotide
cccacagatgcagaggacca

SEQ ID NO: 2042 - DNA, 20 bp, Artificial sequence
  Synthetic oligonucleotide
agcccagatatttctttaaa

SEQ ID NO: 2043 - DNA, 20 bp, Artificial sequence
  Synthetic oligonucleotide
gtactaagaatacaaacaaa

SEQ ID NO: 2044 - DNA, 20 bp, Artificial sequence
  Synthetic oligonucleotide
tttgctgacccctatcatct

SEQ ID NO: 2045 - DNA, 20 bp, Artificial sequence
  Synthetic oligonucleotide
acagtttcactaggttctca

SEQ ID NO: 2046 - DNA, 20 bp, Artificial sequence
  Synthetic oligonucleotide
tttctacaaaaacggatata

SEQ ID NO: 2047 - DNA, 20 bp, Artificial sequence
  Synthetic oligonucleotide
ctgtagaagaactaagacaa

SEQ ID NO: 2048 - DNA, 20 bp, Artificial sequence
  Synthetic oligonucleotide
tgtccagaatgggcaaacct

SEQ ID NO: 2049 - DNA, 20 bp, Artificial sequence
  Synthetic oligonucleotide
tgttttaactaagagtcagc

SEQ ID NO: 2050 - DNA, 20 bp, Artificial sequence
  Synthetic oligonucleotide
ggccagagcggataccatat

SEQ ID NO: 2051 - DNA, 20 bp, Artificial sequence
  Synthetic oligonucleotide
tatttagtcatttttagcac

SEQ ID NO: 2052 - DNA, 20 bp, Artificial sequence
  Synthetic oligonucleotide
aaaagtagctctttctaaag

SEQ ID NO: 2053 - DNA, 20 bp, Artificial sequence
  Synthetic oligonucleotide
attaacacactctcactttg

SEQ ID NO: 2054 - DNA, 20 bp, Artificial sequence
  Synthetic oligonucleotide
taagaccaagaaatttatgt

SEQ ID NO: 2055 - DNA, 20 bp, Artificial sequence
  Synthetic oligonucleotide
ccttttgccaaacacatggg

SEQ ID NO: 2056 - DNA, 20 bp, Artificial sequence
  Synthetic oligonucleotide
gtcctttaaagccacagttt

SEQ ID NO: 2057 - DNA, 20 bp, Artificial sequence
  Synthetic oligonucleotide
ttctctgagatctcttctct

SEQ ID NO: 2058 - DNA, 20 bp, Artificial sequence
  Synthetic oligonucleotide
acagttaaacacttatctaa

SEQ ID NO: 2059 - DNA, 20 bp, Artificial sequence
  Synthetic oligonucleotide
gctgtaaaatgaacctaagt

SEQ ID NO: 2060 - DNA, 20 bp, Artificial sequence
  Synthetic oligonucleotide
atgtttatagaatgtactga

SEQ ID NO: 2061 - DNA, 20 bp, Artificial sequence
  Synthetic oligonucleotide
cagaagccctttgttacata

SEQ ID NO: 2062 - DNA, 20 bp, Artificial sequence
  Synthetic oligonucleotide
aaagctgaatagatacatgt

SEQ ID NO: 2063 - DNA, 20 bp, Artificial sequence
  Synthetic oligonucleotide
acacttcacacccacaagga

SEQ ID NO: 2064 - DNA, 20 bp, Artificial sequence
  Synthetic oligonucleotide
tagggtttcgccatgttatc

SEQ ID NO: 2065 - DNA, 20 bp, Artificial sequence
  Synthetic oligonucleotide
acttttggtgttgctttttc

SEQ ID NO: 2066 - DNA, 20 bp, Artificial sequence
  Synthetic oligonucleotide
agtaataccccaaaagtaca

SEQ ID NO: 2067 - DNA, 20 bp, Artificial sequence
  Synthetic oligonucleotide
cagctatagaatacacattc

SEQ ID NO: 2068 - DNA, 20 bp, Artificial sequence
  Synthetic oligonucleotide
gatacctctacagagtcaca

SEQ ID NO: 2069 - DNA, 20 bp, Artificial sequence
  Synthetic oligonucleotide
ggcagatttatagttcagaa

SEQ ID NO: 2070 - DNA, 20 bp, Artificial sequence
  Synthetic oligonucleotide
ccccaatttatcaataagct

SEQ ID NO: 2071 - DNA, 20 bp, Artificial sequence
  Synthetic oligonucleotide
aaaaacaacaataaattcaa

SEQ ID NO: 2072 - DNA, 20 bp, Artificial sequence
  Synthetic oligonucleotide
aagttcccattgcattgttt

SEQ ID NO: 2073 - DNA, 20 bp, Artificial sequence
  Synthetic oligonucleotide
ggacagagaagaggaacagg

SEQ ID NO: 2074 - DNA, 20 bp, Artificial sequence
  Synthetic oligonucleotide
aaaacaccaacatggtgatt

SEQ ID NO: 2075 - DNA, 20 bp, Artificial sequence
  Synthetic oligonucleotide
agggtaaccaaacagctgga

SEQ ID NO: 2076 - DNA, 20 bp, Artificial sequence
  Synthetic oligonucleotide
agtataacacagcaccatgt

SEQ ID NO: 2077 - DNA, 20 bp, Artificial sequence
  Synthetic oligonucleotide
acagtgaaaaatctattatt

SEQ ID NO: 2078 - DNA, 20 bp, Artificial sequence
  Synthetic oligonucleotide
agcctgcctccatacagaca

SEQ ID NO: 2079 - DNA, 20 bp, Artificial sequence
  Synthetic oligonucleotide
tcataagagatgacaagcac

SEQ ID NO: 2080 - DNA, 20 bp, Artificial sequence
  Synthetic oligonucleotide
acctactatcttttacacac

SEQ ID NO: 2081 - DNA, 20 bp, Artificial sequence
  Synthetic oligonucleotide
attctgttcatggaggttca

SEQ ID NO: 2082 - DNA, 20 bp, Artificial sequence
  Synthetic oligonucleotide
gtgactatggacagcacacc

SEQ ID NO: 2083 - DNA, 20 bp, Artificial sequence
  Synthetic oligonucleotide
aagcgacaggaaagaattga

SEQ ID NO: 2084 - DNA, 20 bp, Artificial sequence
  Synthetic oligonucleotide
gagcccttgtttcctttttc

SEQ ID NO: 2085 - DNA, 20 bp, Artificial sequence
  Synthetic oligonucleotide
aactggcaacaccacacatc

SEQ ID NO: 2086 - DNA, 20 bp, Artificial sequence
  Synthetic oligonucleotide
tggctgcggcgaagcggcga

SEQ ID NO: 2087 - DNA, 20 bp, Artificial sequence
  Synthetic oligonucleotide
agaccaaggagccgccggga

SEQ ID NO: 2088 - DNA, 20 bp, Artificial sequence
  Synthetic oligonucleotide
tactctccattatttcttca

SEQ ID NO: 2089 - DNA, 20 bp, Artificial sequence
  Synthetic oligonucleotide
tgtatttttcttcctcactc

SEQ ID NO: 2090 - DNA, 20 bp, Artificial sequence
  Synthetic oligonucleotide
gatacaaattctaggccact

SEQ ID NO: 2091 - DNA, 20 bp, Artificial sequence
  Synthetic oligonucleotide
atccttagcacttggttcaa

SEQ ID NO: 2092 - DNA, 20 bp, Artificial sequence
  Synthetic oligonucleotide
cttgattcactggcatgggc

SEQ ID NO: 2093 - DNA, 20 bp, Artificial sequence
  Synthetic oligonucleotide
gggcagccttacaactgctg

SEQ ID NO: 2094 - DNA, 20 bp, Artificial sequence
  Synthetic oligonucleotide
caagtatcttccactgcaag

SEQ ID NO: 2095 - DNA, 20 bp, Artificial sequence
  Synthetic oligonucleotide
tgctagctgatgtgttcatg

SEQ ID NO: 2096 - DNA, 20 bp, Artificial sequence
  Synthetic oligonucleotide
acagtgatcacctcatcaaa

SEQ ID NO: 2097 - DNA, 20 bp, Artificial sequence
  Synthetic oligonucleotide
gccagagcctcactggcgca

SEQ ID NO: 2098 - DNA, 20 bp, Artificial sequence
  Synthetic oligonucleotide
accacccgcgcgccggagag

SEQ ID NO: 2099 - DNA, 20 bp, Artificial sequence
  Synthetic oligonucleotide
gaattatctgccaaatctct

SEQ ID NO: 2100 - DNA, 20 bp, Artificial sequence
  Synthetic oligonucleotide
ccaatccatttaaaattgta

SEQ ID NO: 2101 - DNA, 20 bp, Artificial sequence
  Synthetic oligonucleotide
tttaagatttaggatttttt

SEQ ID NO: 2102 - DNA, 20 bp, Artificial sequence
  Synthetic oligonucleotide
cacaaataattaccagcaaa

SEQ ID NO: 2103 - DNA, 20 bp, Artificial sequence
  Synthetic oligonucleotide
gaccaatatctgtactccca

SEQ ID NO: 2104 - DNA, 20 bp, Artificial sequence
  Synthetic oligonucleotide
aagttcctgctttcatagag

SEQ ID NO: 2105 - DNA, 20 bp, Artificial sequence
  Synthetic oligonucleotide
gcagccaatgatgagatact

SEQ ID NO: 2106 - DNA, 20 bp, Artificial sequence
  Synthetic oligonucleotide
cgggcccggcccgcatgttt

SEQ ID NO: 2107 - DNA, 20 bp, Artificial sequence
  Synthetic oligonucleotide
accagcctgacaggctgggc

SEQ ID NO: 2108 - DNA, 20 bp, Artificial sequence
  Synthetic oligonucleotide
ccaagcccatcaataccact

SEQ ID NO: 2109 - DNA, 20 bp, Artificial sequence
  Synthetic oligonucleotide
aatattccatacagatcgca

SEQ ID NO: 2110 - DNA, 20 bp, Artificial sequence
  Synthetic oligonucleotide
ctctattggtactgtcacca

SEQ ID NO: 2111 - DNA, 20 bp, Artificial sequence
  Synthetic oligonucleotide
gaaagataaagttgtttatt

SEQ ID NO: 2112 - DNA, 20 bp, Artificial sequence
  Synthetic oligonucleotide
tactggttcttgaccagaaa

SEQ ID NO: 2113 - DNA, 20 bp, Artificial sequence
  Synthetic oligonucleotide
cagcatcacctagtaattag

SEQ ID NO: 2114 - DNA, 20 bp, Artificial sequence
  Synthetic oligonucleotide
ttacttttaatcttttcatt

SEQ ID NO: 2115 - DNA, 20 bp, Artificial sequence
  Synthetic oligonucleotide
ttaaagtgaaatgttatatt

SEQ ID NO: 2116 - DNA, 20 bp, Artificial sequence
  Synthetic oligonucleotide
gcataaagaactctgcagac

SEQ ID NO: 2117 - DNA, 20 bp, Artificial sequence
  Synthetic oligonucleotide
aaccatgcctcttttttctc

SEQ ID NO: 2118 - DNA, 20 bp, Artificial sequence
  Synthetic oligonucleotide
tacaaactaattttttaaga

SEQ ID NO: 2119 - DNA, 20 bp, Artificial sequence
  Synthetic oligonucleotide
ttgattaaaccataccttcc

SEQ ID NO: 2120 - DNA, 20 bp, Artificial sequence
  Synthetic oligonucleotide
agccatcaaaacagccatag

SEQ ID NO: 2121 - DNA, 20 bp, Artificial sequence
  Synthetic oligonucleotide
cacagtttcactaggttctc

SEQ ID NO: 2122 - DNA, 20 bp, Artificial sequence
  Synthetic oligonucleotide
tctaataagctttagaatca

SEQ ID NO: 2123 - DNA, 20 bp, Artificial sequence
  Synthetic oligonucleotide
agaaaaaagaagaaaatgat

SEQ ID NO: 2124 - DNA, 20 bp, Artificial sequence
  Synthetic oligonucleotide
agaaaaaaaaaggctatata

SEQ ID NO: 2125 - DNA, 20 bp, Artificial sequence
  Synthetic oligonucleotide
ggaaagtggagtaagtaggg

SEQ ID NO: 2126 - DNA, 20 bp, Artificial sequence
  Synthetic oligonucleotide
gtgatgaacatacataataa

SEQ ID NO: 2127 - DNA, 20 bp, Artificial sequence
  Synthetic oligonucleotide
cctgcggcactttcaacaac

SEQ ID NO: 2128 - DNA, 20 bp, Artificial sequence
  Synthetic oligonucleotide
caccaaaagtagctctttct

SEQ ID NO: 2129 - DNA, 20 bp, Artificial sequence
  Synthetic oligonucleotide
tcccagaacccacttcttca

SEQ ID NO: 2130 - DNA, 20 bp, Artificial sequence
  Synthetic oligonucleotide
cagcatacccagctaagcac

SEQ ID NO: 2131 - DNA, 20 bp, Artificial sequence
  Synthetic oligonucleotide
actataatgtaagtctacca

SEQ ID NO: 2132 - DNA, 20 bp, Artificial sequence
  Synthetic oligonucleotide
aaagaaaagcaaaatgagtc

SEQ ID NO: 2133 - DNA, 20 bp, Artificial sequence
  Synthetic oligonucleotide
ctatcttcacaacatttttt

SEQ ID NO: 2134 - DNA, 20 bp, Artificial sequence
  Synthetic oligonucleotide
ctgtgagtatcaaatgataa

SEQ ID NO: 2135 - DNA, 20 bp, Artificial sequence
  Synthetic oligonucleotide
tcagctacatgggctgtcgc

SEQ ID NO: 2136 - DNA, 20 bp, Artificial sequence
  Synthetic oligonucleotide
cagatgctatagaaacacac

SEQ ID NO: 2137 - DNA, 20 bp, Artificial sequence
  Synthetic oligonucleotide
tcaatttcacagctgagatt

SEQ ID NO: 2138 - DNA, 20 bp, Artificial sequence
  Synthetic oligonucleotide
attaaagctgaatagataca

SEQ ID NO: 2139 - DNA, 20 bp, Artificial sequence
  Synthetic oligonucleotide
acaaaagatgttcaacatca

SEQ ID NO: 2140 - DNA, 20 bp, Artificial sequence
  Synthetic oligonucleotide
atattttttttttccactct

SEQ ID NO: 2141 - DNA, 20 bp, Artificial sequence
  Synthetic oligonucleotide
agtgaaggcaaaaatcagac

SEQ ID NO: 2142 - DNA, 20 bp, Artificial sequence
  Synthetic oligonucleotide
tggcatggtactggcataaa

SEQ ID NO: 2143 - DNA, 20 bp, Artificial sequence
  Synthetic oligonucleotide
ctcagtaacagtcggaaact

SEQ ID NO: 2144 - DNA, 20 bp, Artificial sequence
  Synthetic oligonucleotide
ggaattctcccagatcttcc

SEQ ID NO: 2145 - DNA, 20 bp, Artificial sequence
  Synthetic oligonucleotide
ataaaggaacttaaaagcta

SEQ ID NO: 2146 - DNA, 20 bp, Artificial sequence
  Synthetic oligonucleotide
taaaaaaaaattgcctcaaa

SEQ ID NO: 2147 - DNA, 20 bp, Artificial sequence
  Synthetic oligonucleotide
aaggctttggctacaaaaac

SEQ ID NO: 2148 - DNA, 20 bp, Artificial sequence
  Synthetic oligonucleotide
gacaacaaaaagttcccatt

SEQ ID NO: 2149 - DNA, 20 bp, Artificial sequence
  Synthetic oligonucleotide
acagttggacagagaagagg

SEQ ID NO: 2150 - DNA, 20 bp, Artificial sequence
  Synthetic oligonucleotide
ctaactgtatgcttaatagt

SEQ ID NO: 2151 - DNA, 20 bp, Artificial sequence
  Synthetic oligonucleotide
gactgccttaaaaagggaaa

SEQ ID NO: 2152 - DNA, 20 bp, Artificial sequence
  Synthetic oligonucleotide
ccaacactaactttctatct

SEQ ID NO: 2153 - DNA, 20 bp, Artificial sequence
  Synthetic oligonucleotide
atggacattttattttaaat

SEQ ID NO: 2154 - DNA, 20 bp, Artificial sequence
  Synthetic oligonucleotide
acagccttgctcctagcctg

SEQ ID NO: 2155 - DNA, 20 bp, Artificial sequence
  Synthetic oligonucleotide
ttttcataagagatgacaag

SEQ ID NO: 2156 - DNA, 20 bp, Artificial sequence
  Synthetic oligonucleotide
acatttgagacctcaaattg

SEQ ID NO: 2157 - DNA, 20 bp, Artificial sequence
  Synthetic oligonucleotide
cccagcctcttaaaaatgtc

SEQ ID NO: 2158 - DNA, 20 bp, Artificial sequence
  Synthetic oligonucleotide
gttgagaatcagaagcagag

SEQ ID NO: 2159 - DNA, 20 bp, Artificial sequence
  Synthetic oligonucleotide
ataaccttcacattctactt

SEQ ID NO: 2160 - DNA, 20 bp, Artificial sequence
  Synthetic oligonucleotide
tcaacctggtctcactcact

SEQ ID NO: 2161 - DNA, 20 bp, Artificial sequence
  Synthetic oligonucleotide
tgaaacagaaaactggcaac

SEQ ID NO: 2162 - DNA, 20 bp, Artificial sequence
  Synthetic oligonucleotide
ccgggccacctggctgcggc

SEQ ID NO: 2163 - DNA, 20 bp, Artificial sequence
  Synthetic oligonucleotide
cgccgagaccaaggagccgc

SEQ ID NO: 2164 - DNA, 20 bp, Artificial sequence
  Synthetic oligonucleotide
aatactctccattatttctt

SEQ ID NO: 2165 - DNA, 20 bp, Artificial sequence
  Synthetic oligonucleotide
gtgtatttttcttcctcact

SEQ ID NO: 2166 - DNA, 20 bp, Artificial sequence
  Synthetic oligonucleotide
gggatacaaattctaggcca

SEQ ID NO: 2167 - DNA, 20 bp, Artificial sequence
  Synthetic oligonucleotide
aatccttagcacttggttca

SEQ ID NO: 2168 - DNA, 20 bp, Artificial sequence
  Synthetic oligonucleotide
ggcttgattcactggcatgg

SEQ ID NO: 2169 - DNA, 20 bp, Artificial sequence
  Synthetic oligonucleotide
ctccagggcagccttacaac

SEQ ID NO: 2170 - DNA, 20 bp, Artificial sequence
  Synthetic oligonucleotide
cggtccaagtatcttccact

SEQ ID NO: 2171 - DNA, 20 bp, Artificial sequence
  Synthetic oligonucleotide
tcttttgctagctgatgtgt

SEQ ID NO: 2172 - DNA, 20 bp, Artificial sequence
  Synthetic oligonucleotide
accactgtagacagtgatca

SEQ ID NO: 2173 - DNA, 20 bp, Artificial sequence
  Synthetic oligonucleotide
accttgccagagcctcactg

SEQ ID NO: 2174 - DNA, 20 bp, Artificial sequence
  Synthetic oligonucleotide
tgcggatcggccaccacccg

SEQ ID NO: 2175 - DNA, 20 bp, Artificial sequence
  Synthetic oligonucleotide
tgcaacttaataaccttagt

SEQ ID NO: 2176 - DNA, 20 bp, Artificial sequence
  Synthetic oligonucleotide
gactaattaacctagataaa

SEQ ID NO: 2177 - DNA, 20 bp, Artificial sequence
  Synthetic oligonucleotide
gcttagagtttttgccttcc

SEQ ID NO: 2178 - DNA, 20 bp, Artificial sequence
  Synthetic oligonucleotide
ctttaaatgttaatgagaat

SEQ ID NO: 2179 - DNA, 20 bp, Artificial sequence
  Synthetic oligonucleotide
ctcccaggccgggagtggtg

SEQ ID NO: 2180 - DNA, 20 bp, Artificial sequence
  Synthetic oligonucleotide
taaataaactaagcctgaga

SEQ ID NO: 2181 - DNA, 20 bp, Artificial sequence
  Synthetic oligonucleotide
aagtacatcagattctaatg

SEQ ID NO: 2182 - DNA, 20 bp, Artificial sequence
  Synthetic oligonucleotide
aaacacttgttcctactgtc

SEQ ID NO: 2183 - DNA, 20 bp, Artificial sequence
  Synthetic oligonucleotide
cagatatggcactaccagcc

SEQ ID NO: 2184 - DNA, 20 bp, Artificial sequence
  Synthetic oligonucleotide
gtctgacagcatcaaatgtg

SEQ ID NO: 2185 - DNA, 20 bp, Artificial sequence
  Synthetic oligonucleotide
ggaaattaagtaatattcca

SEQ ID NO: 2186 - DNA, 20 bp, Artificial sequence
  Synthetic oligonucleotide
atctgaggtcaggaactcaa

SEQ ID NO: 2187 - DNA, 20 bp, Artificial sequence
  Synthetic oligonucleotide
caggaattaaaggccagtct

SEQ ID NO: 2188 - DNA, 20 bp, Artificial sequence
  Synthetic oligonucleotide
tgtagaatatacatatttac

SEQ ID NO: 2189 - DNA, 20 bp, Artificial sequence
  Synthetic oligonucleotide
tatgagggactagagcatcc

SEQ ID NO: 2190 - DNA, 20 bp, Artificial sequence
  Synthetic oligonucleotide
ctaatttccactgatctatg

SEQ ID NO: 2191 - DNA, 20 bp, Artificial sequence
  Synthetic oligonucleotide
acatcattaaagtgaaatgt

SEQ ID NO: 2192 - DNA, 20 bp, Artificial sequence
  Synthetic oligonucleotide
aaaagcataaagaactctgc

SEQ ID NO: 2193 - DNA, 20 bp, Artificial sequence
  Synthetic oligonucleotide
cgcaaccatgcctctttttt

SEQ ID NO: 2194 - DNA, 20 bp, Artificial sequence
  Synthetic oligonucleotide
cacatgcccacttataaact

SEQ ID NO: 2195 - DNA, 20 bp, Artificial sequence
  Synthetic oligonucleotide
acaccctgactgtccagagc

SEQ ID NO: 2196 - DNA, 20 bp, Artificial sequence
  Synthetic oligonucleotide
ctctatggctacagccatca

SEQ ID NO: 2197 - DNA, 20 bp, Artificial sequence
  Synthetic oligonucleotide
tcactaggtacacagtttca

SEQ ID NO: 2198 - DNA, 20 bp, Artificial sequence
  Synthetic oligonucleotide
tgtggaaaaaaatttccaaa

SEQ ID NO: 2199 - DNA, 20 bp, Artificial sequence
  Synthetic oligonucleotide
gctcaggagttcaagacagc

SEQ ID NO: 2200 - DNA, 20 bp, Artificial sequence
  Synthetic oligonucleotide
ctgcaatcatgccactgcgc

SEQ ID NO: 2201 - DNA, 20 bp, Artificial sequence
  Synthetic oligonucleotide
actggttctccaactgtact

SEQ ID NO: 2202 - DNA, 20 bp, Artificial sequence
  Synthetic oligonucleotide
gcattaaatattaagatcca

SEQ ID NO: 2203 - DNA, 20 bp, Artificial sequence
  Synthetic oligonucleotide
tcaaagttccatataaacct

SEQ ID NO: 2204 - DNA, 20 bp, Artificial sequence
  Synthetic oligonucleotide
ttcaccaaaagtagctcttt

SEQ ID NO: 2205 - DNA, 20 bp, Artificial sequence
  Synthetic oligonucleotide
gccattctaagtggtttaac

SEQ ID NO: 2206 - DNA, 20 bp, Artificial sequence
  Synthetic oligonucleotide
taacactcatttttggcaag

SEQ ID NO: 2207 - DNA, 20 bp, Artificial sequence
  Synthetic oligonucleotide
taaccttgggtcctcctgtg

SEQ ID NO: 2208 - DNA, 20 bp, Artificial sequence
  Synthetic oligonucleotide
tctctttctaagggcactct

SEQ ID NO: 2209 - DNA, 20 bp, Artificial sequence
  Synthetic oligonucleotide
ccacttgacctctctatggc

SEQ ID NO: 2210 - DNA, 20 bp, Artificial sequence
  Synthetic oligonucleotide
gtttggaatcttattaagca

SEQ ID NO: 2211 - DNA, 20 bp, Artificial sequence
  Synthetic oligonucleotide
ttcttctggcattctaaaaa

SEQ ID NO: 2212 - DNA, 20 bp, Artificial sequence
  Synthetic oligonucleotide
atattccttatgctaatcac

SEQ ID NO: 2213 - DNA, 20 bp, Artificial sequence
  Synthetic oligonucleotide
tataatatcaccctctaaca

SEQ ID NO: 2214 - DNA, 20 bp, Artificial sequence
  Synthetic oligonucleotide
aactgttaatagcattaaag

SEQ ID NO: 2215 - DNA, 20 bp, Artificial sequence
  Synthetic oligonucleotide
catcaatccaaagaagatat

SEQ ID NO: 2216 - DNA, 20 bp, Artificial sequence
  Synthetic oligonucleotide
catattttttttttccactc

SEQ ID NO: 2217 - DNA, 20 bp, Artificial sequence
  Synthetic oligonucleotide
ctttagtagaggcgatccac

SEQ ID NO: 2218 - DNA, 20 bp, Artificial sequence
  Synthetic oligonucleotide
atcattatctgacttcaaat

SEQ ID NO: 2219 - DNA, 20 bp, Artificial sequence
  Synthetic oligonucleotide
gacctcagtaacagtcggaa

SEQ ID NO: 2220 - DNA, 20 bp, Artificial sequence
  Synthetic oligonucleotide
catttgtttggagaaatgta

SEQ ID NO: 2221 - DNA, 20 bp, Artificial sequence
  Synthetic oligonucleotide
aaaggaatatgacaataaag

SEQ ID NO: 2222 - DNA, 20 bp, Artificial sequence
  Synthetic oligonucleotide
gacatacctggaaaaagtca

SEQ ID NO: 2223 - DNA, 20 bp, Artificial sequence
  Synthetic oligonucleotide
cttggtgtcagatacaaaca

SEQ ID NO: 2224 - DNA, 20 bp, Artificial sequence
  Synthetic oligonucleotide
agccaaactgtcatgcttgc

SEQ ID NO: 2225 - DNA, 20 bp, Artificial sequence
  Synthetic oligonucleotide
tagtaaaagaaggcagatta

SEQ ID NO: 2226 - DNA, 20 bp, Artificial sequence
  Synthetic oligonucleotide
aacaaacccacctctgcaaa

SEQ ID NO: 2227 - DNA, 20 bp, Artificial sequence
  Synthetic oligonucleotide
tttggaggataacagaaaac

SEQ ID NO: 2228 - DNA, 20 bp, Artificial sequence
  Synthetic oligonucleotide
aacagatccaacactaactt

SEQ ID NO: 2229 - DNA, 20 bp, Artificial sequence
  Synthetic oligonucleotide
aatgaaatcagtactattta

SEQ ID NO: 2230 - DNA, 20 bp, Artificial sequence
  Synthetic oligonucleotide
cctccccaagttcttggatt

SEQ ID NO: 2231 - DNA, 20 bp, Artificial sequence
  Synthetic oligonucleotide
ttcattttcataagagatga

SEQ ID NO: 2232 - DNA, 20 bp, Artificial sequence
  Synthetic oligonucleotide
gggaagttgtgctaaggcaa

SEQ ID NO: 2233 - DNA, 20 bp, Artificial sequence
  Synthetic oligonucleotide
gactacaggcgcgcctggct

SEQ ID NO: 2234 - DNA, 20 bp, Artificial sequence
  Synthetic oligonucleotide
gaactgaaagccagttcttt

SEQ ID NO: 2235 - DNA, 20 bp, Artificial sequence
  Synthetic oligonucleotide
aaaggactgaccaatcagca

SEQ ID NO: 2236 - DNA, 20 bp, Artificial sequence
  Synthetic oligonucleotide
ttgcctctctccctctgctt

SEQ ID NO: 2237 - DNA, 20 bp, Artificial sequence
  Synthetic oligonucleotide
gaaaagcgaacattgaaaca

SEQ ID NO: 2238 - DNA, 20 bp, Artificial sequence
  Synthetic oligonucleotide
gccacccgggccacctggct

SEQ ID NO: 2239 - DNA, 20 bp, Artificial sequence
  Synthetic oligonucleotide
aggcccgccgagaccaagga

SEQ ID NO: 2240 - DNA, 20 bp, Artificial sequence
  Synthetic oligonucleotide
acaaaatactctccattatt

SEQ ID NO: 2241 - DNA, 20 bp, Artificial sequence
  Synthetic oligonucleotide
tgtgtatttttcttcctcac

SEQ ID NO: 2242 - DNA, 20 bp, Artificial sequence
  Synthetic oligonucleotide
ggttgtgggatacaaattct

SEQ ID NO: 2243 - DNA, 20 bp, Artificial sequence
  Synthetic oligonucleotide
gaatccttagcacttggttc

SEQ ID NO: 2244 - DNA, 20 bp, Artificial sequence
  Synthetic oligonucleotide
tggcttgattcactggcatg

SEQ ID NO: 2245 - DNA, 20 bp, Artificial sequence
  Synthetic oligonucleotide
ggcctttcggttcctccagg

SEQ ID NO: 2246 - DNA, 20 bp, Artificial sequence
  Synthetic oligonucleotide
ctactcggtccaagtatctt

SEQ ID NO: 2247 - DNA, 20 bp, Artificial sequence
  Synthetic oligonucleotide
ttacttcttttgctagctga

SEQ ID NO: 2248 - DNA, 20 bp, Artificial sequence
  Synthetic oligonucleotide
cttaaaagttgaaccactgt

SEQ ID NO: 2249 - DNA, 20 bp, Artificial sequence
  Synthetic oligonucleotide
cccacaccttgccagagcct

SEQ ID NO: 2250 - DNA, 20 bp, Artificial sequence
  Synthetic oligonucleotide
agcaatgcggatcggccacc

SEQ ID NO: 2251 - DNA, 20 bp, Artificial sequence
  Synthetic oligonucleotide
aaagaccttgtggtactaaa

SEQ ID NO: 2252 - DNA, 20 bp, Artificial sequence
  Synthetic oligonucleotide
ataaattactaatgaagcca

SEQ ID NO: 2253 - DNA, 20 bp, Artificial sequence
  Synthetic oligonucleotide
caaagcttagagtttttgcc

SEQ ID NO: 2254 - DNA, 20 bp, Artificial sequence
  Synthetic oligonucleotide
tatttgcaacactgcactcc

SEQ ID NO: 2255 - DNA, 20 bp, Artificial sequence
  Synthetic oligonucleotide
acctggtgttatgagtcacc

SEQ ID NO: 2256 - DNA, 20 bp, Artificial sequence
  Synthetic oligonucleotide
agtatctcagtttttttttt

SEQ ID NO: 2257 - DNA, 20 bp, Artificial sequence
  Synthetic oligonucleotide
gaaataaaagtacatcagat

SEQ ID NO: 2258 - DNA, 20 bp, Artificial sequence
  Synthetic oligonucleotide
ccatcccagataacacggcg

SEQ ID NO: 2259 - DNA, 20 bp, Artificial sequence
  Synthetic oligonucleotide
aaagactttgaaatctcaca

SEQ ID NO: 2260 - DNA, 20 bp, Artificial sequence
  Synthetic oligonucleotide
tgcatgcctgccttctctac

SEQ ID NO: 2261 - DNA, 20 bp, Artificial sequence
  Synthetic oligonucleotide
ttcataaggttgtggaaatt

SEQ ID NO: 2262 - DNA, 20 bp, Artificial sequence
  Synthetic oligonucleotide
cgtatgtttgtctgtcttat

SEQ ID NO: 2263 - DNA, 20 bp, Artificial sequence
  Synthetic oligonucleotide
ggtgcagcctgtagtctcag

SEQ ID NO: 2264 - DNA, 20 bp, Artificial sequence
  Synthetic oligonucleotide
tccacatatatatgtagaat

SEQ ID NO: 2265 - DNA, 20 bp, Artificial sequence
  Synthetic oligonucleotide
aatcactcgagattaaaaac

SEQ ID NO: 2266 - DNA, 20 bp, Artificial sequence
  Synthetic oligonucleotide
tataaaaaaacagtacagta

SEQ ID NO: 2267 - DNA, 20 bp, Artificial sequence
  Synthetic oligonucleotide
atagaatataatacaaccta

SEQ ID NO: 2268 - DNA, 20 bp, Artificial sequence
  Synthetic oligonucleotide
caaaataaaaagcataaaga

SEQ ID NO: 2269 - DNA, 20 bp, Artificial sequence
  Synthetic oligonucleotide
tgtcatactgtattgtttta

SEQ ID NO: 2270 - DNA, 20 bp, Artificial sequence
  Synthetic oligonucleotide
ctcaaaaccttgtctcatac

SEQ ID NO: 2271 - DNA, 20 bp, Artificial sequence
  Synthetic oligonucleotide
gaaacccatagctcacaccc

SEQ ID NO: 2272 - DNA, 20 bp, Artificial sequence
  Synthetic oligonucleotide
cagctacaactactcaactc

SEQ ID NO: 2273 - DNA, 20 bp, Artificial sequence
  Synthetic oligonucleotide
aaaattaatttttaaaagaa

SEQ ID NO: 2274 - DNA, 20 bp, Artificial sequence
  Synthetic oligonucleotide
acaagttatgttttaattct

SEQ ID NO: 2275 - DNA, 20 bp, Artificial sequence
  Synthetic oligonucleotide
attaggcttctggatcagga

SEQ ID NO: 2276 - DNA, 20 bp, Artificial sequence
  Synthetic oligonucleotide
agatgcggtggctcatggct

SEQ ID NO: 2277 - DNA, 20 bp, Artificial sequence
  Synthetic oligonucleotide
ggtaaaaaagacactacata

SEQ ID NO: 2278 - DNA, 20 bp, Artificial sequence
  Synthetic oligonucleotide
tgttggcatagtaacataca

SEQ ID NO: 2279 - DNA, 20 bp, Artificial sequence
  Synthetic oligonucleotide
aaatcagccttttctcaaac

SEQ ID NO: 2280 - DNA, 20 bp, Artificial sequence
  Synthetic oligonucleotide
tggttttaaaatttcaccaa

SEQ ID NO: 2281 - DNA, 20 bp, Artificial sequence
  Synthetic oligonucleotide
gaagccattctaagtggttt

SEQ ID NO: 2282 - DNA, 20 bp, Artificial sequence
  Synthetic oligonucleotide
atatgttacaaattctcttt

SEQ ID NO: 2283 - DNA, 20 bp, Artificial sequence
  Synthetic oligonucleotide
taaaggttgtaatccatccc

SEQ ID NO: 2284 - DNA, 20 bp, Artificial sequence
  Synthetic oligonucleotide
atataataacaatacaccgt

SEQ ID NO: 2285 - DNA, 20 bp, Artificial sequence
  Synthetic oligonucleotide
cacaaagtttaacagatgcg

SEQ ID NO: 2286 - DNA, 20 bp, Artificial sequence
  Synthetic oligonucleotide
tggttccttacaattatcta

SEQ ID NO: 2287 - DNA, 20 bp, Artificial sequence
  Synthetic oligonucleotide
taagattgcaaagctaactt

SEQ ID NO: 2288 - DNA, 20 bp, Artificial sequence
  Synthetic oligonucleotide
ctgtcagcatattccttatg

SEQ ID NO: 2289 - DNA, 20 bp, Artificial sequence
  Synthetic oligonucleotide
cctttgtaacacagacacta

SEQ ID NO: 2290 - DNA, 20 bp, Artificial sequence
  Synthetic oligonucleotide
tctatttttggtcaagacag

SEQ ID NO: 2291 - DNA, 20 bp, Artificial sequence
  Synthetic oligonucleotide
aagacaactcaatttttaaa

SEQ ID NO: 2292 - DNA, 20 bp, Artificial sequence
  Synthetic oligonucleotide
ttagaaagttcactctttta

SEQ ID NO: 2293 - DNA, 20 bp, Artificial sequence
  Synthetic oligonucleotide
acaaaaatctttagtagagg

SEQ ID NO: 2294 - DNA, 20 bp, Artificial sequence
  Synthetic oligonucleotide
aaaacgggaggaatcattat

SEQ ID NO: 2295 - DNA, 20 bp, Artificial sequence
  Synthetic oligonucleotide
atagattttgagacaaagtc

SEQ ID NO: 2296 - DNA, 20 bp, Artificial sequence
  Synthetic oligonucleotide
ggccatggcagtgcttgtgt

SEQ ID NO: 2297 - DNA, 20 bp, Artificial sequence
  Synthetic oligonucleotide
aagcaccaatggctggacca

SEQ ID NO: 2298 - DNA, 20 bp, Artificial sequence
  Synthetic oligonucleotide
tattctagcatgcagtaatt

SEQ ID NO: 2299 - DNA, 20 bp, Artificial sequence
  Synthetic oligonucleotide
cctaaagagtgcttggtgtc

SEQ ID NO: 2300 - DNA, 20 bp, Artificial sequence
  Synthetic oligonucleotide
ttagaatgtgactctcccat

SEQ ID NO: 2301 - DNA, 20 bp, Artificial sequence
  Synthetic oligonucleotide
atctaaagaggataaatcta

SEQ ID NO: 2302 - DNA, 20 bp, Artificial sequence
  Synthetic oligonucleotide
aagtatttgaacataatcca

SEQ ID NO: 2303 - DNA, 20 bp, Artificial sequence
  Synthetic oligonucleotide
aaaaaaaattccagaagttt

SEQ ID NO: 2304 - DNA, 20 bp, Artificial sequence
  Synthetic oligonucleotide
gcattatgaaatcgcttctc

SEQ ID NO: 2305 - DNA, 20 bp, Artificial sequence
  Synthetic oligonucleotide
ccataatctcattctcatag

SEQ ID NO: 2306 - DNA, 20 bp, Artificial sequence
  Synthetic oligonucleotide
agaacatgcttaagcagatt

SEQ ID NO: 2307 - DNA, 20 bp, Artificial sequence
  Synthetic oligonucleotide
ggcacaaggaaaatattgtt

SEQ ID NO: 2308 - DNA, 20 bp, Artificial sequence
  Synthetic oligonucleotide
gaccaaaccatcataaaatg

SEQ ID NO: 2309 - DNA, 20 bp, Artificial sequence
  Synthetic oligonucleotide
aaaaatttatttttgaataa

SEQ ID NO: 2310 - DNA, 20 bp, Artificial sequence
  Synthetic oligonucleotide
gagtgccccagccctttgga

SEQ ID NO: 2311 - DNA, 20 bp, Artificial sequence
  Synthetic oligonucleotide
gatatttttaaggtctcagt

SEQ ID NO: 2312 - DNA, 20 bp, Artificial sequence
  Synthetic oligonucleotide
ttacttggacctctgttcat

SEQ ID NO: 2313 - DNA, 20 bp, Artificial sequence
  Synthetic oligonucleotide
ttgtactgtaaaaagaaaag

SEQ ID NO: 2314 - DNA, 20 bp, Artificial sequence
  Synthetic oligonucleotide
tttgttactgtttcgacctc

SEQ ID NO: 2315 - DNA, 20 bp, Artificial sequence
  Synthetic oligonucleotide
gctctgttcgatgcaggact

SEQ ID NO: 2316 - DNA, 20 bp, Artificial sequence
  Synthetic oligonucleotide
gttcatgactttcaagggtt

SEQ ID NO: 2317 - DNA, 20 bp, Artificial sequence
  Synthetic oligonucleotide
cttcttttgctagctgatgt

SEQ ID NO: 2318 - DNA, 20 bp, Artificial sequence
  Synthetic oligonucleotide
ttccttctccctttgaacac

SEQ ID NO: 2319 - DNA, 20 bp, Artificial sequence
  Synthetic oligonucleotide
tggctaagtagtgtttggga

SEQ ID NO: 2320 - DNA, 20 bp, Artificial sequence
  Synthetic oligonucleotide
aatctaatttttaagcctag

SEQ ID NO: 2321 - DNA, 20 bp, Artificial sequence
  Synthetic oligonucleotide
ctttcagatgaaaaagaaag

SEQ ID NO: 2322 - DNA, 20 bp, Artificial sequence
  Synthetic oligonucleotide
ggtaacagtaacatcataga

SEQ ID NO: 2323 - DNA, 20 bp, Artificial sequence
  Synthetic oligonucleotide
atgatcttgtgtatatatta

SEQ ID NO: 2324 - DNA, 20 bp, Artificial sequence
  Synthetic oligonucleotide
cgtaagtacagaaccacata

SEQ ID NO: 2325 - DNA, 20 bp, Artificial sequence
  Synthetic oligonucleotide
ctaatgtgtttcacaatcta

SEQ ID NO: 2326 - DNA, 20 bp, Artificial sequence
  Synthetic oligonucleotide
ttctggacaccaaggtgggt

SEQ ID NO: 2327 - DNA, 20 bp, Artificial sequence
  Synthetic oligonucleotide
cattacgaccattctgctca

SEQ ID NO: 2328 - DNA, 20 bp, Artificial sequence
  Synthetic oligonucleotide
gaattcgaggttacacagtt

SEQ ID NO: 2329 - DNA, 20 bp, Artificial sequence
  Synthetic oligonucleotide
ttgtctacagtagcatacag

SEQ ID NO: 2330 - DNA, 20 bp, Artificial sequence
  Synthetic oligonucleotide
ctctgtcgcctgggatggta

SEQ ID NO: 2331 - DNA, 20 bp, Artificial sequence
  Synthetic oligonucleotide
aagcaaagactttgaaatct

SEQ ID NO: 2332 - DNA, 20 bp, Artificial sequence
  Synthetic oligonucleotide
agtgagttccatactctaat

SEQ ID NO: 2333 - DNA, 20 bp, Artificial sequence
  Synthetic oligonucleotide
cagtaattaagaataaaatg

SEQ ID NO: 2334 - DNA, 20 bp, Artificial sequence
  Synthetic oligonucleotide
atattccatacagatcgcat

SEQ ID NO: 2335 - DNA, 20 bp, Artificial sequence
  Synthetic oligonucleotide
cttcttgttgttgtttacat

SEQ ID NO: 2336 - DNA, 20 bp, Artificial sequence
  Synthetic oligonucleotide
ttccaatttcagacttcttg

SEQ ID NO: 2337 - DNA, 20 bp, Artificial sequence
  Synthetic oligonucleotide
tgtttgtctgtcttattcac

SEQ ID NO: 2338 - DNA, 20 bp, Artificial sequence
  Synthetic oligonucleotide
gtgctctctttgcgcctgtg

SEQ ID NO: 2339 - DNA, 20 bp, Artificial sequence
  Synthetic oligonucleotide
tgaatcagtatttactactt

SEQ ID NO: 2340 - DNA, 20 bp, Artificial sequence
  Synthetic oligonucleotide
aatgggataaatatatacaa

SEQ ID NO: 2341 - DNA, 20 bp, Artificial sequence
  Synthetic oligonucleotide
aagagttaatgatgctttca

SEQ ID NO: 2342 - DNA, 20 bp, Artificial sequence
  Synthetic oligonucleotide
aagtaaaatagcctactgga

SEQ ID NO: 2343 - DNA, 20 bp, Artificial sequence
  Synthetic oligonucleotide
aatacttaagtcacttacat

SEQ ID NO: 2344 - DNA, 20 bp, Artificial sequence
  Synthetic oligonucleotide
aaaaatcctcatatctaaat

SEQ ID NO: 2345 - DNA, 20 bp, Artificial sequence
  Synthetic oligonucleotide
tgttaggaattctttagctc

SEQ ID NO: 2346 - DNA, 20 bp, Artificial sequence
  Synthetic oligonucleotide
tccaagtaacagtgtagaag

SEQ ID NO: 2347 - DNA, 20 bp, Artificial sequence
  Synthetic oligonucleotide
cagttgccaattctgagaca

SEQ ID NO: 2348 - DNA, 20 bp, Artificial sequence
  Synthetic oligonucleotide
agtaattcttcagactaaat

SEQ ID NO: 2349 - DNA, 20 bp, Artificial sequence
  Synthetic oligonucleotide
agtttcactaggttctcaaa

SEQ ID NO: 2350 - DNA, 20 bp, Artificial sequence
  Synthetic oligonucleotide
tctttcttttaatctcaata

SEQ ID NO: 2351 - DNA, 20 bp, Artificial sequence
  Synthetic oligonucleotide
ttttgtttaatcacagtttt

SEQ ID NO: 2352 - DNA, 20 bp, Artificial sequence
  Synthetic oligonucleotide
aacaaacagagaggaactgc

SEQ ID NO: 2353 - DNA, 20 bp, Artificial sequence
  Synthetic oligonucleotide
agaatccacagatccaggtg

SEQ ID NO: 2354 - DNA, 20 bp, Artificial sequence
  Synthetic oligonucleotide
atgggccccttcaatatttt

SEQ ID NO: 2355 - DNA, 20 bp, Artificial sequence
  Synthetic oligonucleotide
gaaaacacagaagtgtgatt

SEQ ID NO: 2356 - DNA, 20 bp, Artificial sequence
  Synthetic oligonucleotide
cagtactgtaagttgccact

SEQ ID NO: 2357 - DNA, 20 bp, Artificial sequence
  Synthetic oligonucleotide
atttcctttaaatacctagt

SEQ ID NO: 2358 - DNA, 20 bp, Artificial sequence
  Synthetic oligonucleotide
actatcaactgccactgctg

SEQ ID NO: 2359 - DNA, 20 bp, Artificial sequence
  Synthetic oligonucleotide
tggctccaatatcggcaatg

SEQ ID NO: 2360 - DNA, 20 bp, Artificial sequence
  Synthetic oligonucleotide
atggctgattccatcaatct

SEQ ID NO: 2361 - DNA, 20 bp, Artificial sequence
  Synthetic oligonucleotide
acataggttagaattttcca

SEQ ID NO: 2362 - DNA, 20 bp, Artificial sequence
  Synthetic oligonucleotide
gtttcttttacttaagttgc

SEQ ID NO: 2363 - DNA, 20 bp, Artificial sequence
  Synthetic oligonucleotide
catatatttctcagccccct

SEQ ID NO: 2364 - DNA, 20 bp, Artificial sequence
  Synthetic oligonucleotide
tagagtttgtgactcctgtg

SEQ ID NO: 2365 - DNA, 20 bp, Artificial sequence
  Synthetic oligonucleotide
tgaacccagaactcagtttg

SEQ ID NO: 2366 - DNA, 20 bp, Artificial sequence
  Synthetic oligonucleotide
taaatcacaataattcctac

SEQ ID NO: 2367 - DNA, 20 bp, Artificial sequence
  Synthetic oligonucleotide
ttgatttgtgataagtttta

SEQ ID NO: 2368 - DNA, 20 bp, Artificial sequence
  Synthetic oligonucleotide
caaaaatgatttcttgtaca

SEQ ID NO: 2369 - DNA, 20 bp, Artificial sequence
  Synthetic oligonucleotide
ttaacggttgcttagggttg

SEQ ID NO: 2370 - DNA, 20 bp, Artificial sequence
  Synthetic oligonucleotide
agactttttatgttgctcct

SEQ ID NO: 2371 - DNA, 20 bp, Artificial sequence
  Synthetic oligonucleotide
agcaattcttacacaaataa

SEQ ID NO: 2372 - DNA, 20 bp, Artificial sequence
  Synthetic oligonucleotide
tcagtataggcaaaccaatt

SEQ ID NO: 2373 - DNA, 20 bp, Artificial sequence
  Synthetic oligonucleotide
aagttaaaaagcgggcagat

SEQ ID NO: 2374 - DNA, 20 bp, Artificial sequence
  Synthetic oligonucleotide
ctgggcctagtcagcttgga

SEQ ID NO: 2375 - DNA, 20 bp, Artificial sequence
  Synthetic oligonucleotide
acccaaaaaaacacattgag

SEQ ID NO: 2376 - DNA, 20 bp, Artificial sequence
  Synthetic oligonucleotide
caaaaagttcccattgcatt

SEQ ID NO: 2377 - DNA, 20 bp, Artificial sequence
  Synthetic oligonucleotide
caatattctgagaaaggact

SEQ ID NO: 2378 - DNA, 20 bp, Artificial sequence
  Synthetic oligonucleotide
taattatagagttcatatgg

SEQ ID NO: 2379 - DNA, 20 bp, Artificial sequence
  Synthetic oligonucleotide
ttacttattaccttcctgta

SEQ ID NO: 2380 - DNA, 20 bp, Artificial sequence
  Synthetic oligonucleotide
aaaaaagcagactgcctatt

SEQ ID NO: 2381 - DNA, 20 bp, Artificial sequence
  Synthetic oligonucleotide
tttttgcttattattctcac

SEQ ID NO: 2382 - DNA, 20 bp, Artificial sequence
  Synthetic oligonucleotide
catgtagttacatgtaacca

SEQ ID NO: 2383 - DNA, 20 bp, Artificial sequence
  Synthetic oligonucleotide
ggctgtttcaaaaccaatga

SEQ ID NO: 2384 - DNA, 20 bp, Artificial sequence
  Synthetic oligonucleotide
ggtcaaggtcaatacttttt

SEQ ID NO: 2385 - DNA, 20 bp, Artificial sequence
  Synthetic oligonucleotide
gctgtccaagataatgacct

SEQ ID NO: 2386 - DNA, 20 bp, Artificial sequence
  Synthetic oligonucleotide
ttaatttgtaactaggtttt

SEQ ID NO: 2387 - DNA, 20 bp, Artificial sequence
  Synthetic oligonucleotide
cccctactgttaaaccatta

SEQ ID NO: 2388 - DNA, 20 bp, Artificial sequence
  Synthetic oligonucleotide
atgtctgacaacctccatcg

SEQ ID NO: 2389 - DNA, 20 bp, Artificial sequence
  Synthetic oligonucleotide
cagaacctaaactttgcagg

SEQ ID NO: 2390 - DNA, 20 bp, Artificial sequence
  Synthetic oligonucleotide
ctttgttactgtttcgacct

SEQ ID NO: 2391 - DNA, 20 bp, Artificial sequence
  Synthetic oligonucleotide
gtttcattgggtttaatatt

SEQ ID NO: 2392 - DNA, 20 bp, Artificial sequence
  Synthetic oligonucleotide
tgttcatgactttcaagggt

SEQ ID NO: 2393 - DNA, 20 bp, Artificial sequence
  Synthetic oligonucleotide
acttcttttgctagctgatg

SEQ ID NO: 2394 - DNA, 20 bp, Artificial sequence
  Synthetic oligonucleotide
gggaggccgcccgctccctc

SEQ ID NO: 2395 - DNA, 20 bp, Artificial sequence
  Synthetic oligonucleotide
tttccttctccctttgaaca

SEQ ID NO: 2396 - DNA, 20 bp, Artificial sequence
  Synthetic oligonucleotide
acatccttttctataaaagt

SEQ ID NO: 2397 - DNA, 20 bp, Artificial sequence
  Synthetic oligonucleotide
gaaaaatctaaattaacctt

SEQ ID NO: 2398 - DNA, 20 bp, Artificial sequence
  Synthetic oligonucleotide
ggaatgtagaagaagaagag

SEQ ID NO: 2399 - DNA, 20 bp, Artificial sequence
  Synthetic oligonucleotide
gagtttttgccttccatttt

SEQ ID NO: 2400 - DNA, 20 bp, Artificial sequence
  Synthetic oligonucleotide
catgatcttgtgtatatatt

SEQ ID NO: 2401 - DNA, 20 bp, Artificial sequence
  Synthetic oligonucleotide
acagctgtgacaagttttca

SEQ ID NO: 2402 - DNA, 20 bp, Artificial sequence
  Synthetic oligonucleotide
aaaaatgcttgtcataatcc

SEQ ID NO: 2403 - DNA, 20 bp, Artificial sequence
  Synthetic oligonucleotide
aagtgccaaccattcaagaa

SEQ ID NO: 2404 - DNA, 20 bp, Artificial sequence
  Synthetic oligonucleotide
tcattacgaccattctgctc

SEQ ID NO: 2405 - DNA, 20 bp, Artificial sequence
  Synthetic oligonucleotide
tgaccaatgctcctctctgc

SEQ ID NO: 2406 - DNA, 20 bp, Artificial sequence
  Synthetic oligonucleotide
aaccagtaagttaaggtaaa

SEQ ID NO: 2407 - DNA, 20 bp, Artificial sequence
  Synthetic oligonucleotide
ccagaaaaaatggccactac

SEQ ID NO: 2408 - DNA, 20 bp, Artificial sequence
  Synthetic oligonucleotide
aaagcaaagactttgaaatc

SEQ ID NO: 2409 - DNA, 20 bp, Artificial sequence
  Synthetic oligonucleotide
tgttcagtgtccttctagcc

SEQ ID NO: 2410 - DNA, 20 bp, Artificial sequence
  Synthetic oligonucleotide
cagtgaggaaggagaccatc

SEQ ID NO: 2411 - DNA, 20 bp, Artificial sequence
  Synthetic oligonucleotide
taatattccatacagatcgc

SEQ ID NO: 2412 - DNA, 20 bp, Artificial sequence
  Synthetic oligonucleotide
acttcttgttgttgtttaca

SEQ ID NO: 2413 - DNA, 20 bp, Artificial sequence
  Synthetic oligonucleotide
cttccaatttcagacttctt

SEQ ID NO: 2414 - DNA, 20 bp, Artificial sequence
  Synthetic oligonucleotide
atgtttgtctgtcttattca

SEQ ID NO: 2415 - DNA, 20 bp, Artificial sequence
  Synthetic oligonucleotide
tgtgctctctttgcgcctgt

SEQ ID NO: 2416 - DNA, 20 bp, Artificial sequence
  Synthetic oligonucleotide
atgaatcagtatttactact

SEQ ID NO: 2417 - DNA, 20 bp, Artificial sequence
  Synthetic oligonucleotide
gcatcactacttggtaacac

SEQ ID NO: 2418 - DNA, 20 bp, Artificial sequence
  Synthetic oligonucleotide
tttaccattctgtctacttt

SEQ ID NO: 2419 - DNA, 20 bp, Artificial sequence
  Synthetic oligonucleotide
agagctcacctaatattaag

SEQ ID NO: 2420 - DNA, 20 bp, Artificial sequence
  Synthetic oligonucleotide
cttcagataccgaattacat

SEQ ID NO: 2421 - DNA, 20 bp, Artificial sequence
  Synthetic oligonucleotide
tattatccattccatcattt

SEQ ID NO: 2422 - DNA, 20 bp, Artificial sequence
  Synthetic oligonucleotide
taaaatttgttaggaattct

SEQ ID NO: 2423 - DNA, 20 bp, Artificial sequence
  Synthetic oligonucleotide
agaacactgtgctttcatca

SEQ ID NO: 2424 - DNA, 20 bp, Artificial sequence
  Synthetic oligonucleotide
caaatgataacagcagagac

SEQ ID NO: 2425 - DNA, 20 bp, Artificial sequence
  Synthetic oligonucleotide
agaagataaatttgtagata

SEQ ID NO: 2426 - DNA, 20 bp, Artificial sequence
  Synthetic oligonucleotide
cagtttcactaggttctcaa

SEQ ID NO: 2427 - DNA, 20 bp, Artificial sequence
  Synthetic oligonucleotide
attctgtttagctttccatt

SEQ ID NO: 2428 - DNA, 20 bp, Artificial sequence
  Synthetic oligonucleotide
tttctacttttcccagtttg

SEQ ID NO: 2429 - DNA, 20 bp, Artificial sequence
  Synthetic oligonucleotide
caggattatgtataaatcaa

SEQ ID NO: 2430 - DNA, 20 bp, Artificial sequence
  Synthetic oligonucleotide
ttgagaatccacagatccag

SEQ ID NO: 2431 - DNA, 20 bp, Artificial sequence
  Synthetic oligonucleotide
gggattcttagcctttttct

SEQ ID NO: 2432 - DNA, 20 bp, Artificial sequence
  Synthetic oligonucleotide
aatgctacattttaatctta

SEQ ID NO: 2433 - DNA, 20 bp, Artificial sequence
  Synthetic oligonucleotide
cccatagggtaccacctact

SEQ ID NO: 2434 - DNA, 20 bp, Artificial sequence
  Synthetic oligonucleotide
accgtctcacacagaccttg

SEQ ID NO: 2435 - DNA, 20 bp, Artificial sequence
  Synthetic oligonucleotide
ttagcatgacatgccaagtc

SEQ ID NO: 2436 - DNA, 20 bp, Artificial sequence
  Synthetic oligonucleotide
atggctccaatatcggcaat

SEQ ID NO: 2437 - DNA, 20 bp, Artificial sequence
  Synthetic oligonucleotide
gtgctcattctcatcccact

SEQ ID NO: 2438 - DNA, 20 bp, Artificial sequence
  Synthetic oligonucleotide
cacataggttagaattttcc

SEQ ID NO: 2439 - DNA, 20 bp, Artificial sequence
  Synthetic oligonucleotide
acaagatatattcaacctag

SEQ ID NO: 2440 - DNA, 20 bp, Artificial sequence
  Synthetic oligonucleotide
tcatatatttctcagccccc

SEQ ID NO: 2441 - DNA, 20 bp, Artificial sequence
  Synthetic oligonucleotide
aagcaagtcccatttaagta

SEQ ID NO: 2442 - DNA, 20 bp, Artificial sequence
  Synthetic oligonucleotide
atctatgattttcatcaggt

SEQ ID NO: 2443 - DNA, 20 bp, Artificial sequence
  Synthetic oligonucleotide
atataacatacactagataa

SEQ ID NO: 2444 - DNA, 20 bp, Artificial sequence
  Synthetic oligonucleotide
ttgaggacagtcatttgatt

SEQ ID NO: 2445 - DNA, 20 bp, Artificial sequence
  Synthetic oligonucleotide
cacctgacagaacaaatgat

SEQ ID NO: 2446 - DNA, 20 bp, Artificial sequence
  Synthetic oligonucleotide
agaacaccacaaatagctac

SEQ ID NO: 2447 - DNA, 20 bp, Artificial sequence
  Synthetic oligonucleotide
taagactttttatgttgctc

SEQ ID NO: 2448 - DNA, 20 bp, Artificial sequence
  Synthetic oligonucleotide
atgtatagaggccaacattc

SEQ ID NO: 2449 - DNA, 20 bp, Artificial sequence
  Synthetic oligonucleotide
aacaagctaaagagaaacct

SEQ ID NO: 2450 - DNA, 20 bp, Artificial sequence
  Synthetic oligonucleotide
gtctctcaatagcagaaatg

SEQ ID NO: 2451 - DNA, 20 bp, Artificial sequence
  Synthetic oligonucleotide
tgggcagtctatacggaatt

SEQ ID NO: 2452 - DNA, 20 bp, Artificial sequence
  Synthetic oligonucleotide
cgaaaattaagagttttagt

SEQ ID NO: 2453 - DNA, 20 bp, Artificial sequence
  Synthetic oligonucleotide
acaaaaagttcccattgcat

SEQ ID NO: 2454 - DNA, 20 bp, Artificial sequence
  Synthetic oligonucleotide
aagcatgaaccttaagagaa

SEQ ID NO: 2455 - DNA, 20 bp, Artificial sequence
  Synthetic oligonucleotide
aaaagttaccacaatatgaa

SEQ ID NO: 2456 - DNA, 20 bp, Artificial sequence
  Synthetic oligonucleotide
gttacttattaccttcctgt

SEQ ID NO: 2457 - DNA, 20 bp, Artificial sequence
  Synthetic oligonucleotide
gttcatcttttccttcagat

SEQ ID NO: 2458 - DNA, 20 bp, Artificial sequence
  Synthetic oligonucleotide
ttttttgcttattattctca

SEQ ID NO: 2459 - DNA, 20 bp, Artificial sequence
  Synthetic oligonucleotide
ccatgtagttacatgtaacc

SEQ ID NO: 2460 - DNA, 20 bp, Artificial sequence
  Synthetic oligonucleotide
cccactgctcttcaaatgga

SEQ ID NO: 2461 - DNA, 20 bp, Artificial sequence
  Synthetic oligonucleotide
agagtagatgtgaggctggg

SEQ ID NO: 2462 - DNA, 20 bp, Artificial sequence
  Synthetic oligonucleotide
tgctgtccaagataatgacc

SEQ ID NO: 2463 - DNA, 20 bp, Artificial sequence
  Synthetic oligonucleotide
tttaatttgtaactaggttt

SEQ ID NO: 2464 - DNA, 20 bp, Artificial sequence
  Synthetic oligonucleotide
aagtagctaatacggtggac

SEQ ID NO: 2465 - DNA, 20 bp, Artificial sequence
  Synthetic oligonucleotide
ggagcatgtacacaaccgat

SEQ ID NO: 2466 - DNA, 20 bp, Artificial sequence
  Synthetic oligonucleotide
gaccaaaccggcttccctcc

SEQ ID NO: 2467 - DNA, 20 bp, Artificial sequence
  Synthetic oligonucleotide
ttctcatgtgcggcatcaag

SEQ ID NO: 2468 - DNA, 20 bp, Artificial sequence
  Synthetic oligonucleotide
tgtttcattgggtttaatat

SEQ ID NO: 2469 - DNA, 20 bp, Artificial sequence
  Synthetic oligonucleotide
gtgttcatgactttcaaggg

SEQ ID NO: 2470 - DNA, 20 bp, Artificial sequence
  Synthetic oligonucleotide
tacttcttttgctagctgat

SEQ ID NO: 2471 - DNA, 20 bp, Artificial sequence
  Synthetic oligonucleotide
cgagaacccctcccaacacg

SEQ ID NO: 2472 - DNA, 20 bp, Artificial sequence
  Synthetic oligonucleotide
gtttccttctccctttgaac

SEQ ID NO: 2473 - DNA, 20 bp, Artificial sequence
  Synthetic oligonucleotide
cttaataaccttagttttaa

SEQ ID NO: 2474 - DNA, 20 bp, Artificial sequence
  Synthetic oligonucleotide
taagtgaggagattctagaa

SEQ ID NO: 2475 - DNA, 20 bp, Artificial sequence
  Synthetic oligonucleotide
gtaacaattgtaaatccata

SEQ ID NO: 2476 - DNA, 20 bp, Artificial sequence
  Synthetic oligonucleotide
agagtttttgccttccattt

SEQ ID NO: 2477 - DNA, 20 bp, Artificial sequence
  Synthetic oligonucleotide
gcatgatcttgtgtatatat

SEQ ID NO: 2478 - DNA, 20 bp, Artificial sequence
  Synthetic oligonucleotide
tcacttgacacaacttcagg

SEQ ID NO: 2479 - DNA, 20 bp, Artificial sequence
  Synthetic oligonucleotide
attacaatgcggtatatata

SEQ ID NO: 2480 - DNA, 20 bp, Artificial sequence
  Synthetic oligonucleotide
tgaccaagcagttaagtgcc

SEQ ID NO: 2481 - DNA, 20 bp, Artificial sequence
  Synthetic oligonucleotide
catcattacgaccattctgc

SEQ ID NO: 2482 - DNA, 20 bp, Artificial sequence
  Synthetic oligonucleotide
acagtttagcaattactttt

SEQ ID NO: 2483 - DNA, 20 bp, Artificial sequence
  Synthetic oligonucleotide
gcaaatatttccaaacaagt

SEQ ID NO: 2484 - DNA, 20 bp, Artificial sequence
  Synthetic oligonucleotide
aaaggcaatttccttaattt

SEQ ID NO: 2485 - DNA, 20 bp, Artificial sequence
  Synthetic oligonucleotide
gctcccagccttcttcactg

SEQ ID NO: 2486 - DNA, 20 bp, Artificial sequence
  Synthetic oligonucleotide
ttgttcagtgtccttctagc

SEQ ID NO: 2487 - DNA, 20 bp, Artificial sequence
  Synthetic oligonucleotide
ctcgaatggcagaacaatga

SEQ ID NO: 2488 - DNA, 20 bp, Artificial sequence
  Synthetic oligonucleotide
gtaatattccatacagatcg

SEQ ID NO: 2489 - DNA, 20 bp, Artificial sequence
  Synthetic oligonucleotide
gacttcttgttgttgtttac

SEQ ID NO: 2490 - DNA, 20 bp, Artificial sequence
  Synthetic oligonucleotide
tcttccaatttcagacttct

SEQ ID NO: 2491 - DNA, 20 bp, Artificial sequence
  Synthetic oligonucleotide
tatgtttgtctgtcttattc

SEQ ID NO: 2492 - DNA, 20 bp, Artificial sequence
  Synthetic oligonucleotide
atgtgctctctttgcgcctg

SEQ ID NO: 2493 - DNA, 20 bp, Artificial sequence
  Synthetic oligonucleotide
catgaatcagtatttactac

SEQ ID NO: 2494 - DNA, 20 bp, Artificial sequence
  Synthetic oligonucleotide
gggactagagcatccataaa

SEQ ID NO: 2495 - DNA, 20 bp, Artificial sequence
  Synthetic oligonucleotide
tgcttttaatagttgccaaa

SEQ ID NO: 2496 - DNA, 20 bp, Artificial sequence
  Synthetic oligonucleotide
tacccccaaggcagtttatc

SEQ ID NO: 2497 - DNA, 20 bp, Artificial sequence
  Synthetic oligonucleotide
gaactcttgaaattcttcag

SEQ ID NO: 2498 - DNA, 20 bp, Artificial sequence
  Synthetic oligonucleotide
ggtaccagttcttatatgcc

SEQ ID NO: 2499 - DNA, 20 bp, Artificial sequence
  Synthetic oligonucleotide
tactccaaacctttacaaaa

SEQ ID NO: 2500 - DNA, 20 bp, Artificial sequence
  Synthetic oligonucleotide
atttgagaagattcaaaaac

SEQ ID NO: 2501 - DNA, 20 bp, Artificial sequence
  Synthetic oligonucleotide
cttaataatttgacagacta

SEQ ID NO: 2502 - DNA, 20 bp, Artificial sequence
  Synthetic oligonucleotide
actaaaaccagaggaaaaat

SEQ ID NO: 2503 - DNA, 20 bp, Artificial sequence
  Synthetic oligonucleotide
acacagtttcactaggttct

SEQ ID NO: 2504 - DNA, 20 bp, Artificial sequence
  Synthetic oligonucleotide
agttattgttctgactttgg

SEQ ID NO: 2505 - DNA, 20 bp, Artificial sequence
  Synthetic oligonucleotide
gcaagctgatagacaatcat

SEQ ID NO: 2506 - DNA, 20 bp, Artificial sequence
  Synthetic oligonucleotide
taaacaacagtggccactga

SEQ ID NO: 2507 - DNA, 20 bp, Artificial sequence
  Synthetic oligonucleotide
gttctataggtgcttaagtc

SEQ ID NO: 2508 - DNA, 20 bp, Artificial sequence
  Synthetic oligonucleotide
cacagttaagggtgcaggat

SEQ ID NO: 2509 - DNA, 20 bp, Artificial sequence
  Synthetic oligonucleotide
aaattaaagctcgaagcagc

SEQ ID NO: 2510 - DNA, 20 bp, Artificial sequence
  Synthetic oligonucleotide
gggcaatgatggcactagga

SEQ ID NO: 2511 - DNA, 20 bp, Artificial sequence
  Synthetic oligonucleotide
tacctaagctatattaaagg

SEQ ID NO: 2512 - DNA, 20 bp, Artificial sequence
  Synthetic oligonucleotide
tcaccccatctccttccaac

SEQ ID NO: 2513 - DNA, 20 bp, Artificial sequence
  Synthetic oligonucleotide
catggctccaatatcggcaa

SEQ ID NO: 2514 - DNA, 20 bp, Artificial sequence
  Synthetic oligonucleotide
tctaacctctggactgtccc

SEQ ID NO: 2515 - DNA, 20 bp, Artificial sequence
  Synthetic oligonucleotide
gcacataggttagaattttc

SEQ ID NO: 2516 - DNA, 20 bp, Artificial sequence
  Synthetic oligonucleotide
tatccctgatttatggaaaa

SEQ ID NO: 2517 - DNA, 20 bp, Artificial sequence
  Synthetic oligonucleotide
atcatatatttctcagcccc

SEQ ID NO: 2518 - DNA, 20 bp, Artificial sequence
  Synthetic oligonucleotide
gaatcttattaagcaagtcc

SEQ ID NO: 2519 - DNA, 20 bp, Artificial sequence
  Synthetic oligonucleotide
ccttacaattatctatgatt

SEQ ID NO: 2520 - DNA, 20 bp, Artificial sequence
  Synthetic oligonucleotide
ctatacacactattgaagaa

SEQ ID NO: 2521 - DNA, 20 bp, Artificial sequence
  Synthetic oligonucleotide
ttttaaccctttgaggacag

SEQ ID NO: 2522 - DNA, 20 bp, Artificial sequence
  Synthetic oligonucleotide
acacctgacagaacaaatga

SEQ ID NO: 2523 - DNA, 20 bp, Artificial sequence
  Synthetic oligonucleotide
caactcctaggtaggtacac

SEQ ID NO: 2524 - DNA, 20 bp, Artificial sequence
  Synthetic oligonucleotide
ataagactttttatgttgct

SEQ ID NO: 2525 - DNA, 20 bp, Artificial sequence
  Synthetic oligonucleotide
aaacactttataggcaatat

SEQ ID NO: 2526 - DNA, 20 bp, Artificial sequence
  Synthetic oligonucleotide
aatcagtttattgaaggaat

SEQ ID NO: 2527 - DNA, 20 bp, Artificial sequence
  Synthetic oligonucleotide
gagactgcaataattattag

SEQ ID NO: 2528 - DNA, 20 bp, Artificial sequence
  Synthetic oligonucleotide
gtttctcagtaaagtgtcag

SEQ ID NO: 2529 - DNA, 20 bp, Artificial sequence
  Synthetic oligonucleotide
acccactttcttctcagaat

SEQ ID NO: 2530 - DNA, 20 bp, Artificial sequence
  Synthetic oligonucleotide
caaaagcattactcattgcc

SEQ ID NO: 2531 - DNA, 20 bp, Artificial sequence
  Synthetic oligonucleotide
atacaatacagtcaactgaa

SEQ ID NO: 2532 - DNA, 20 bp, Artificial sequence
  Synthetic oligonucleotide
aaaaactaagggaaaaactg

SEQ ID NO: 2533 - DNA, 20 bp, Artificial sequence
  Synthetic oligonucleotide
ttgttacttattaccttcct

SEQ ID NO: 2534 - DNA, 20 bp, Artificial sequence
  Synthetic oligonucleotide
gtagaaactatttgccaaaa

SEQ ID NO: 2535 - DNA, 20 bp, Artificial sequence
  Synthetic oligonucleotide
aagttgatctacacaaattt

SEQ ID NO: 2536 - DNA, 20 bp, Artificial sequence
  Synthetic oligonucleotide
cccatgtagttacatgtaac

SEQ ID NO: 2537 - DNA, 20 bp, Artificial sequence
  Synthetic oligonucleotide
gttttgtttgcaacatttcc

SEQ ID NO: 2538 - DNA, 20 bp, Artificial sequence
  Synthetic oligonucleotide
tatttgagtgtatttaaata

SEQ ID NO: 2539 - DNA, 20 bp, Artificial sequence
  Synthetic oligonucleotide
taccttaaaagttcatttcc

SEQ ID NO: 2540 - DNA, 20 bp, Artificial sequence
  Synthetic oligonucleotide
tgtttaatttgtaactaggt

SEQ ID NO: 2541 - DNA, 20 bp, Artificial sequence
  Synthetic oligonucleotide
tctgaatgtttttaagagta

SEQ ID NO: 2542 - DNA, 20 bp, Artificial sequence
  Synthetic oligonucleotide
gaaagttggctaaagctggt

SEQ ID NO: 2543 - DNA, 20 bp, Artificial sequence
  Synthetic oligonucleotide
ctggcccacacggaccaaac

SEQ ID NO: 2544 - DNA, 20 bp, Artificial sequence
  Synthetic oligonucleotide
tctgtacttttctcatgtgc

SEQ ID NO: 2545 - DNA, 20 bp, Artificial sequence
  Synthetic oligonucleotide
aagctaggtgatgtttcatt

SEQ ID NO: 2546 - DNA, 20 bp, Artificial sequence
  Synthetic oligonucleotide
gatgtgttcatgactttcaa

SEQ ID NO: 2547 - DNA, 20 bp, Artificial sequence
  Synthetic oligonucleotide
tgttacttcttttgctagct

SEQ ID NO: 2548 - DNA, 20 bp, Artificial sequence
  Synthetic oligonucleotide
cgatctttcccaggactcgg

SEQ ID NO: 2549 - DNA, 20 bp, Artificial sequence
  Synthetic oligonucleotide
agtgtttgggatgcttcaga

SEQ ID NO: 2550 - DNA, 20 bp, Artificial sequence
  Synthetic oligonucleotide
aacttaataaccttagtttt

SEQ ID NO: 2551 - DNA, 20 bp, Artificial sequence
  Synthetic oligonucleotide
cacttctgaaagtcatgaaa

SEQ ID NO: 2552 - DNA, 20 bp, Artificial sequence
  Synthetic oligonucleotide
aatttaaatggaagcatgat

SEQ ID NO: 2553 - DNA, 20 bp, Artificial sequence
  Synthetic oligonucleotide
ttagagtttttgccttccat

SEQ ID NO: 2554 - DNA, 20 bp, Artificial sequence
  Synthetic oligonucleotide
acagcatgatcttgtgtata

SEQ ID NO: 2555 - DNA, 20 bp, Artificial sequence
  Synthetic oligonucleotide
gttagctattaatcatggca

SEQ ID NO: 2556 - DNA, 20 bp, Artificial sequence
  Synthetic oligonucleotide
gaattacaatgcggtatata

SEQ ID NO: 2557 - DNA, 20 bp, Artificial sequence
  Synthetic oligonucleotide
ccagtatctcagtttttttt

SEQ ID NO: 2558 - DNA, 20 bp, Artificial sequence
  Synthetic oligonucleotide
gcgcatcattacgaccattc

SEQ ID NO: 2559 - DNA, 20 bp, Artificial sequence
  Synthetic oligonucleotide
atttttactcaccttttcta

SEQ ID NO: 2560 - DNA, 20 bp, Artificial sequence
  Synthetic oligonucleotide
ataaacacagggtaggccag

SEQ ID NO: 2561 - DNA, 20 bp, Artificial sequence
  Synthetic oligonucleotide
ctttgaaatctcacaaggtt

SEQ ID NO: 2562 - DNA, 20 bp, Artificial sequence
  Synthetic oligonucleotide
ggattgttttcttcattatt

SEQ ID NO: 2563 - DNA, 20 bp, Artificial sequence
  Synthetic oligonucleotide
tcttgttcagtgtccttcta

SEQ ID NO: 2564 - DNA, 20 bp, Artificial sequence
  Synthetic oligonucleotide
aaataacttgccttacatca

SEQ ID NO: 2565 - DNA, 20 bp, Artificial sequence
  Synthetic oligonucleotide
aagtaatattccatacagat

SEQ ID NO: 2566 - DNA, 20 bp, Artificial sequence
  Synthetic oligonucleotide
cagacttcttgttgttgttt

SEQ ID NO: 2567 - DNA, 20 bp, Artificial sequence
  Synthetic oligonucleotide
gttcttccaatttcagactt

SEQ ID NO: 2568 - DNA, 20 bp, Artificial sequence
  Synthetic oligonucleotide
aaatgttttcataactgcta

SEQ ID NO: 2569 - DNA, 20 bp, Artificial sequence
  Synthetic oligonucleotide
acatgtgctctctttgcgcc

SEQ ID NO: 2570 - DNA, 20 bp, Artificial sequence
  Synthetic oligonucleotide
aacaaccaagcttggcaaaa

SEQ ID NO: 2571 - DNA, 20 bp, Artificial sequence
  Synthetic oligonucleotide
gagggactagagcatccata

SEQ ID NO: 2572 - DNA, 20 bp, Artificial sequence
  Synthetic oligonucleotide
ccactgaagtctaaattctt

SEQ ID NO: 2573 - DNA, 20 bp, Artificial sequence
  Synthetic oligonucleotide
tttatccacattttaacttc

SEQ ID NO: 2574 - DNA, 20 bp, Artificial sequence
  Synthetic oligonucleotide
ttcactaacaaaacaataaa

SEQ ID NO: 2575 - DNA, 20 bp, Artificial sequence
  Synthetic oligonucleotide
catcaaggtaccagttctta

SEQ ID NO: 2576 - DNA, 20 bp, Artificial sequence
  Synthetic oligonucleotide
atttttctctaaagttctaa

SEQ ID NO: 2577 - DNA, 20 bp, Artificial sequence
  Synthetic oligonucleotide
aggaatggactatcacaaac

SEQ ID NO: 2578 - DNA, 20 bp, Artificial sequence
  Synthetic oligonucleotide
ttccccagcagccgagtgtg

SEQ ID NO: 2579 - DNA, 20 bp, Artificial sequence
  Synthetic oligonucleotide
taatggctagaagaattcag

SEQ ID NO: 2580 - DNA, 20 bp, Artificial sequence
  Synthetic oligonucleotide
gtacacagtttcactaggtt

SEQ ID NO: 2581 - DNA, 20 bp, Artificial sequence
  Synthetic oligonucleotide
cacacagtatttttttatcg

SEQ ID NO: 2582 - DNA, 20 bp, Artificial sequence
  Synthetic oligonucleotide
ctacttgttttacttaaacc

SEQ ID NO: 2583 - DNA, 20 bp, Artificial sequence
  Synthetic oligonucleotide
tccagaaaagtttaatgcat

SEQ ID NO: 2584 - DNA, 20 bp, Artificial sequence
  Synthetic oligonucleotide
gagttctataggtgcttaag

SEQ ID NO: 2585 - DNA, 20 bp, Artificial sequence
  Synthetic oligonucleotide
ctatataaagtatcagtata

SEQ ID NO: 2586 - DNA, 20 bp, Artificial sequence
  Synthetic oligonucleotide
aacctaccttaagatcctga

SEQ ID NO: 2587 - DNA, 20 bp, Artificial sequence
  Synthetic oligonucleotide
aagttcaggccctacagtat

SEQ ID NO: 2588 - DNA, 20 bp, Artificial sequence
  Synthetic oligonucleotide
ggattgctcaccgtgatata

SEQ ID NO: 2589 - DNA, 20 bp, Artificial sequence
  Synthetic oligonucleotide
gtctcagccagtcctcaatg

SEQ ID NO: 2590 - DNA, 20 bp, Artificial sequence
  Synthetic oligonucleotide
tttcatggctccaatatcgg

SEQ ID NO: 2591 - DNA, 20 bp, Artificial sequence
  Synthetic oligonucleotide
tggtcaaaatacttgcctcc

SEQ ID NO: 2592 - DNA, 20 bp, Artificial sequence
  Synthetic oligonucleotide
gttgcacataggttagaatt

SEQ ID NO: 2593 - DNA, 20 bp, Artificial sequence
  Synthetic oligonucleotide
cactcttttcccacaaagtt

SEQ ID NO: 2594 - DNA, 20 bp, Artificial sequence
  Synthetic oligonucleotide
agtatcatatatttctcagc

SEQ ID NO: 2595 - DNA, 20 bp, Artificial sequence
  Synthetic oligonucleotide
tggaatcttattaagcaagt

SEQ ID NO: 2596 - DNA, 20 bp, Artificial sequence
  Synthetic oligonucleotide
ttccttacaattatctatga

SEQ ID NO: 2597 - DNA, 20 bp, Artificial sequence
  Synthetic oligonucleotide
ttaattaggatctatacaca

SEQ ID NO: 2598 - DNA, 20 bp, Artificial sequence
  Synthetic oligonucleotide
cattttaaccctttgaggac

SEQ ID NO: 2599 - DNA, 20 bp, Artificial sequence
  Synthetic oligonucleotide
agtaatgcttattttctaaa

SEQ ID NO: 2600 - DNA, 20 bp, Artificial sequence
  Synthetic oligonucleotide
aaacagtattttcttagata

SEQ ID NO: 2601 - DNA, 20 bp, Artificial sequence
  Synthetic oligonucleotide
agataagactttttatgttg

SEQ ID NO: 2602 - DNA, 20 bp, Artificial sequence
  Synthetic oligonucleotide
ttaactcatggcaaccaccg

SEQ ID NO: 2603 - DNA, 20 bp, Artificial sequence
  Synthetic oligonucleotide
tacatcttaacagaataaaa

SEQ ID NO: 2604 - DNA, 20 bp, Artificial sequence
  Synthetic oligonucleotide
ccctctaatgcatgtatggc

SEQ ID NO: 2605 - DNA, 20 bp, Artificial sequence
  Synthetic oligonucleotide
actataaactaacaataaca

SEQ ID NO: 2606 - DNA, 20 bp, Artificial sequence
  Synthetic oligonucleotide
cccattgcattgttttaagt

SEQ ID NO: 2607 - DNA, 20 bp, Artificial sequence
  Synthetic oligonucleotide
tgaaaatctaaggccacatg

SEQ ID NO: 2608 - DNA, 20 bp, Artificial sequence
  Synthetic oligonucleotide
agtatatgatgacctcaatg

SEQ ID NO: 2609 - DNA, 20 bp, Artificial sequence
  Synthetic oligonucleotide
actcctcactgaaagtacac

SEQ ID NO: 2610 - DNA, 20 bp, Artificial sequence
  Synthetic oligonucleotide
ctttgttacttattaccttc

SEQ ID NO: 2611 - DNA, 20 bp, Artificial sequence
  Synthetic oligonucleotide
attattctcacatataaata

SEQ ID NO: 2612 - DNA, 20 bp, Artificial sequence
  Synthetic oligonucleotide
tttgaagcaatccattaatt

SEQ ID NO: 2613 - DNA, 20 bp, Artificial sequence
  Synthetic oligonucleotide
tgcccatgtagttacatgta

SEQ ID NO: 2614 - DNA, 20 bp, Artificial sequence
  Synthetic oligonucleotide
aagggaatcttgattaacta

SEQ ID NO: 2615 - DNA, 20 bp, Artificial sequence
  Synthetic oligonucleotide
cacacaattttgcaaaaaca

SEQ ID NO: 2616 - DNA, 20 bp, Artificial sequence
  Synthetic oligonucleotide
tgacaatattaatggcacaa

SEQ ID NO: 2617 - DNA, 20 bp, Artificial sequence
  Synthetic oligonucleotide
tgtgtttaatttgtaactag

SEQ ID NO: 2618 - DNA, 20 bp, Artificial sequence
  Synthetic oligonucleotide
agcacagctttgggaagagg

SEQ ID NO: 2619 - DNA, 20 bp, Artificial sequence
  Synthetic oligonucleotide
tcccatgacaaaaccacaca

SEQ ID NO: 2620 - DNA, 20 bp, Artificial sequence
  Synthetic oligonucleotide
ccagcctctggtagacacct

SEQ ID NO: 2621 - DNA, 20 bp, Artificial sequence
  Synthetic oligonucleotide
ctgctgtgtatttttcttcc

SEQ ID NO: 2622 - DNA, 20 bp, Artificial sequence
  Synthetic oligonucleotide
ttgtctccttgttgtatggt

SEQ ID NO: 2623 - DNA, 20 bp, Artificial sequence
  Synthetic oligonucleotide
agctgatgtgttcatgactt

SEQ ID NO: 2624 - DNA, 20 bp, Artificial sequence
  Synthetic oligonucleotide
actacaaccccggcttagga

SEQ ID NO: 2625 - DNA, 20 bp, Artificial sequence
  Synthetic oligonucleotide
agtagtgtttgggatgcttc

SEQ ID NO: 2626 - DNA, 20 bp, Artificial sequence
  Synthetic oligonucleotide
atgcaacttaataaccttag

SEQ ID NO: 2627 - DNA, 20 bp, Artificial sequence
  Synthetic oligonucleotide
cccaacaatagaatggttaa

SEQ ID NO: 2628 - DNA, 20 bp, Artificial sequence
  Synthetic oligonucleotide
taggctggtaatttaatgtc

SEQ ID NO: 2629 - DNA, 20 bp, Artificial sequence
  Synthetic oligonucleotide
aagcttagagtttttgcctt

SEQ ID NO: 2630 - DNA, 20 bp, Artificial sequence
  Synthetic oligonucleotide
tacacagcatgatcttgtgt

SEQ ID NO: 2631 - DNA, 20 bp, Artificial sequence
  Synthetic oligonucleotide
tacttgctgccaatatgtac

SEQ ID NO: 2632 - DNA, 20 bp, Artificial sequence
  Synthetic oligonucleotide
ttttgaattacaatgcggta

SEQ ID NO: 2633 - DNA, 20 bp, Artificial sequence
  Synthetic oligonucleotide
cggccagtatctcagttttt

SEQ ID NO: 2634 - DNA, 20 bp, Artificial sequence
  Synthetic oligonucleotide
tgtgcgcatcattacgacca

SEQ ID NO: 2635 - DNA, 20 bp, Artificial sequence
  Synthetic oligonucleotide
ctgtatttttactcaccttt

SEQ ID NO: 2636 - DNA, 20 bp, Artificial sequence
  Synthetic oligonucleotide
agtaaacatcagcatctcaa

SEQ ID NO: 2637 - DNA, 20 bp, Artificial sequence
  Synthetic oligonucleotide
agactttgaaatctcacaag

SEQ ID NO: 2638 - DNA, 20 bp, Artificial sequence
  Synthetic oligonucleotide
caccggattgttttcttcat

SEQ ID NO: 2639 - DNA, 20 bp, Artificial sequence
  Synthetic oligonucleotide
gaagtcttgttcagtgtcct

SEQ ID NO: 2640 - DNA, 20 bp, Artificial sequence
  Synthetic oligonucleotide
ttcatatcacctctgactta

SEQ ID NO: 2641 - DNA, 20 bp, Artificial sequence
  Synthetic oligonucleotide
tgaatattttctccctaaaa

SEQ ID NO: 2642 - DNA, 20 bp, Artificial sequence
  Synthetic oligonucleotide
atttcagacttcttgttgtt

SEQ ID NO: 2643 - DNA, 20 bp, Artificial sequence
  Synthetic oligonucleotide
ttttgttcttccaatttcag

SEQ ID NO: 2644 - DNA, 20 bp, Artificial sequence
  Synthetic oligonucleotide
tctttgcgcctgtgtcacat

SEQ ID NO: 2645 - DNA, 20 bp, Artificial sequence
  Synthetic oligonucleotide
agtatttactacttctgcat

SEQ ID NO: 2646 - DNA, 20 bp, Artificial sequence
  Synthetic oligonucleotide
tgaaaatcagaaaatgatgc

SEQ ID NO: 2647 - DNA, 20 bp, Artificial sequence
  Synthetic oligonucleotide
tttatgagggactagagcat

SEQ ID NO: 2648 - DNA, 20 bp, Artificial sequence
  Synthetic oligonucleotide
aagtacttcacatgcaacat

SEQ ID NO: 2649 - DNA, 20 bp, Artificial sequence
  Synthetic oligonucleotide
cagaggaccaactgtacttt

SEQ ID NO: 2650 - DNA, 20 bp, Artificial sequence
  Synthetic oligonucleotide
gtggctttaaaaactaggta

SEQ ID NO: 2651 - DNA, 20 bp, Artificial sequence
  Synthetic oligonucleotide
gctcatcaaggtaccagttc

SEQ ID NO: 2652 - DNA, 20 bp, Artificial sequence
  Synthetic oligonucleotide
tcttccttagccttatactt

SEQ ID NO: 2653 - DNA, 20 bp, Artificial sequence
  Synthetic oligonucleotide
agagacctgatgtcctaaac

SEQ ID NO: 2654 - DNA, 20 bp, Artificial sequence
  Synthetic oligonucleotide
atagctatgctacaataaaa

SEQ ID NO: 2655 - DNA, 20 bp, Artificial sequence
  Synthetic oligonucleotide
attctttccataaaataatg

SEQ ID NO: 2656 - DNA, 20 bp, Artificial sequence
  Synthetic oligonucleotide
acaattatttgcatcgctga

SEQ ID NO: 2657 - DNA, 20 bp, Artificial sequence
  Synthetic oligonucleotide
ttatttatcagtgtgaagta

SEQ ID NO: 2658 - DNA, 20 bp, Artificial sequence
  Synthetic oligonucleotide
ccctggcaaatatgtaaaac

SEQ ID NO: 2659 - DNA, 20 bp, Artificial sequence
  Synthetic oligonucleotide
tttaatcattgtctatggta

SEQ ID NO: 2660 - DNA, 20 bp, Artificial sequence
  Synthetic oligonucleotide
aactgagttctataggtgct

SEQ ID NO: 2661 - DNA, 20 bp, Artificial sequence
  Synthetic oligonucleotide
ataatgcctctgaaaaatca

SEQ ID NO: 2662 - DNA, 20 bp, Artificial sequence
  Synthetic oligonucleotide
gagcagcaggactcagctgg

SEQ ID NO: 2663 - DNA, 20 bp, Artificial sequence
  Synthetic oligonucleotide
ttaagccacacgaagcattt

SEQ ID NO: 2664 - DNA, 20 bp, Artificial sequence
  Synthetic oligonucleotide
actctacaggttatgctagc

SEQ ID NO: 2665 - DNA, 20 bp, Artificial sequence
  Synthetic oligonucleotide
tcctctctctcttaccagta

SEQ ID NO: 2666 - DNA, 20 bp, Artificial sequence
  Synthetic oligonucleotide
gtttttcatggctccaatat

SEQ ID NO: 2667 - DNA, 20 bp, Artificial sequence
  Synthetic oligonucleotide
cacattcatatcagttatgt

SEQ ID NO: 2668 - DNA, 20 bp, Artificial sequence
  Synthetic oligonucleotide
agtgttgcacataggttaga

SEQ ID NO: 2669 - DNA, 20 bp, Artificial sequence
  Synthetic oligonucleotide
actcaagagtgtccatttgg

SEQ ID NO: 2670 - DNA, 20 bp, Artificial sequence
  Synthetic oligonucleotide
cttaagtatcatatatttct

SEQ ID NO: 2671 - DNA, 20 bp, Artificial sequence
  Synthetic oligonucleotide
agtttggaatcttattaagc

SEQ ID NO: 2672 - DNA, 20 bp, Artificial sequence
  Synthetic oligonucleotide
gctggttccttacaattatc

SEQ ID NO: 2673 - DNA, 20 bp, Artificial sequence
  Synthetic oligonucleotide
gggttaattaggatctatac

SEQ ID NO: 2674 - DNA, 20 bp, Artificial sequence
  Synthetic oligonucleotide
tgtacattttaaccctttga

SEQ ID NO: 2675 - DNA, 20 bp, Artificial sequence
  Synthetic oligonucleotide
attggttggtctcaaaatct

SEQ ID NO: 2676 - DNA, 20 bp, Artificial sequence
  Synthetic oligonucleotide
cattaatgaaggtttacaga

SEQ ID NO: 2677 - DNA, 20 bp, Artificial sequence
  Synthetic oligonucleotide
aaacataagagaataacatt

SEQ ID NO: 2678 - DNA, 20 bp, Artificial sequence
  Synthetic oligonucleotide
gcatttcttactatgggttg

SEQ ID NO: 2679 - DNA, 20 bp, Artificial sequence
  Synthetic oligonucleotide
ataacactagaggccgggca

SEQ ID NO: 2680 - DNA, 20 bp, Artificial sequence
  Synthetic oligonucleotide
agggaaatacctagtcctag

SEQ ID NO: 2681 - DNA, 20 bp, Artificial sequence
  Synthetic oligonucleotide
tatcaggcatggagccactg

SEQ ID NO: 2682 - DNA, 20 bp, Artificial sequence
  Synthetic oligonucleotide
gttcccattgcattgtttta

SEQ ID NO: 2683 - DNA, 20 bp, Artificial sequence
  Synthetic oligonucleotide
ccaattctaggtatttaact

SEQ ID NO: 2684 - DNA, 20 bp, Artificial sequence
  Synthetic oligonucleotide
agtaatgcaccagtacaata

SEQ ID NO: 2685 - DNA, 20 bp, Artificial sequence
  Synthetic oligonucleotide
ccaatacctcaaaggattgg

SEQ ID NO: 2686 - DNA, 20 bp, Artificial sequence
  Synthetic oligonucleotide
ttcctcacacatttcttaca

SEQ ID NO: 2687 - DNA, 20 bp, Artificial sequence
  Synthetic oligonucleotide
cttattattctcacatataa

SEQ ID NO: 2688 - DNA, 20 bp, Artificial sequence
  Synthetic oligonucleotide
gttacatgtaaccataatct

SEQ ID NO: 2689 - DNA, 20 bp, Artificial sequence
  Synthetic oligonucleotide
ttgaaagtgataatgtggaa

SEQ ID NO: 2690 - DNA, 20 bp, Artificial sequence
  Synthetic oligonucleotide
atgatgtagcttaaaaagaa

SEQ ID NO: 2691 - DNA, 20 bp, Artificial sequence
  Synthetic oligonucleotide
actgtacaattaaaaattag

SEQ ID NO: 2692 - DNA, 20 bp, Artificial sequence
  Synthetic oligonucleotide
attaaggaccttagctactt

SEQ ID NO: 2693 - DNA, 20 bp, Artificial sequence
  Synthetic oligonucleotide
atcagtcaaaaatccttaat

SEQ ID NO: 2694 - DNA, 20 bp, Artificial sequence
  Synthetic oligonucleotide
aaccttggtacaaaaaccat

SEQ ID NO: 2695 - DNA, 20 bp, Artificial sequence
  Synthetic oligonucleotide
caatgtccaaggccaagccc

SEQ ID NO: 2696 - DNA, 20 bp, Artificial sequence
  Synthetic oligonucleotide
aaaggtgattttagtcagcc

SEQ ID NO: 2697 - DNA, 20 bp, Artificial sequence
  Synthetic oligonucleotide
tagctgatgtgttcatgact

SEQ ID NO: 2698 - DNA, 20 bp, Artificial sequence
  Synthetic oligonucleotide
actgctgtgtatttttcttc

SEQ ID NO: 2699 - DNA, 20 bp, Artificial sequence
  Synthetic oligonucleotide
cattggcgcatgggcagttg

SEQ ID NO: 2700 - DNA, 20 bp, Artificial sequence
  Synthetic oligonucleotide
tgcacaaacacaccctcgag

SEQ ID NO: 2701 - DNA, 20 bp, Artificial sequence
  Synthetic oligonucleotide
taagtagtgtttgggatgct

SEQ ID NO: 2702 - DNA, 20 bp, Artificial sequence
  Synthetic oligonucleotide
aatgcaacttaataacctta

SEQ ID NO: 2703 - DNA, 20 bp, Artificial sequence
  Synthetic oligonucleotide
ctgaagccctctgaactagt

SEQ ID NO: 2704 - DNA, 20 bp, Artificial sequence
  Synthetic oligonucleotide
cattgctaattagagtaaca

SEQ ID NO: 2705 - DNA, 20 bp, Artificial sequence
  Synthetic oligonucleotide
aaagcttagagtttttgcct

SEQ ID NO: 2706 - DNA, 20 bp, Artificial sequence
  Synthetic oligonucleotide
atacacagcatgatcttgtg

SEQ ID NO: 2707 - DNA, 20 bp, Artificial sequence
  Synthetic oligonucleotide
gtctttcaactttctatcac

SEQ ID NO: 2708 - DNA, 20 bp, Artificial sequence
  Synthetic oligonucleotide
attttgaattacaatgcggt

SEQ ID NO: 2709 - DNA, 20 bp, Artificial sequence
  Synthetic oligonucleotide
aataagccatgatcacaata

SEQ ID NO: 2710 - DNA, 20 bp, Artificial sequence
  Synthetic oligonucleotide
ggcctatgcctttaccgcca

SEQ ID NO: 2711 - DNA, 20 bp, Artificial sequence
  Synthetic oligonucleotide
cgctgtatttttactcacct

SEQ ID NO: 2712 - DNA, 20 bp, Artificial sequence
  Synthetic oligonucleotide
tcagaaagcttctcaaacat

SEQ ID NO: 2713 - DNA, 20 bp, Artificial sequence
  Synthetic oligonucleotide
aagactttgaaatctcacaa

SEQ ID NO: 2714 - DNA, 20 bp, Artificial sequence
  Synthetic oligonucleotide
tcaccggattgttttcttca

SEQ ID NO: 2715 - DNA, 20 bp, Artificial sequence
  Synthetic oligonucleotide
tgaagtcttgttcagtgtcc

SEQ ID NO: 2716 - DNA, 20 bp, Artificial sequence
  Synthetic oligonucleotide
tccatacagatcgcatagct

SEQ ID NO: 2717 - DNA, 20 bp, Artificial sequence
  Synthetic oligonucleotide
gttgttgtttacattattat

SEQ ID NO: 2718 - DNA, 20 bp, Artificial sequence
  Synthetic oligonucleotide
aatttcagacttcttgttgt

SEQ ID NO: 2719 - DNA, 20 bp, Artificial sequence
  Synthetic oligonucleotide
attttgttcttccaatttca

SEQ ID NO: 2720 - DNA, 20 bp, Artificial sequence
  Synthetic oligonucleotide
ctctttgcgcctgtgtcaca

SEQ ID NO: 2721 - DNA, 20 bp, Artificial sequence
  Synthetic oligonucleotide
cagtatttactacttctgca

SEQ ID NO: 2722 - DNA, 20 bp, Artificial sequence
  Synthetic oligonucleotide
ttcgattatctcaatcaaat

SEQ ID NO: 2723 - DNA, 20 bp, Artificial sequence
  Synthetic oligonucleotide
ttttatgagggactagagca

SEQ ID NO: 2724 - DNA, 20 bp, Artificial sequence
  Synthetic oligonucleotide
ttactacaaaaccagacacc

SEQ ID NO: 2725 - DNA, 20 bp, Artificial sequence
  Synthetic oligonucleotide
gaatatggaacccacagatg

SEQ ID NO: 2726 - DNA, 20 bp, Artificial sequence
  Synthetic oligonucleotide
gagaagtaaaatcattcaaa

SEQ ID NO: 2727 - DNA, 20 bp, Artificial sequence
  Synthetic oligonucleotide
tagctcatcaaggtaccagt

SEQ ID NO: 2728 - DNA, 20 bp, Artificial sequence
  Synthetic oligonucleotide
gtatgttctacttcttcacc

SEQ ID NO: 2729 - DNA, 20 bp, Artificial sequence
  Synthetic oligonucleotide
gaaaaccatgcggcctggcc

SEQ ID NO: 2730 - DNA, 20 bp, Artificial sequence
  Synthetic oligonucleotide
catagctatgctacaataaa

SEQ ID NO: 2731 - DNA, 20 bp, Artificial sequence
  Synthetic oligonucleotide
ggaacacatcccagagctct

SEQ ID NO: 2732 - DNA, 20 bp, Artificial sequence
  Synthetic oligonucleotide
aagaccaaaaagacaaccat

SEQ ID NO: 2733 - DNA, 20 bp, Artificial sequence
  Synthetic oligonucleotide
gtttaatcacagttttctca

SEQ ID NO: 2734 - DNA, 20 bp, Artificial sequence
  Synthetic oligonucleotide
ggaggaaaagctagctacct

SEQ ID NO: 2735 - DNA, 20 bp, Artificial sequence
  Synthetic oligonucleotide
aaagcaggatgctacaacgc

SEQ ID NO: 2736 - DNA, 20 bp, Artificial sequence
  Synthetic oligonucleotide
taactgagttctataggtgc

SEQ ID NO: 2737 - DNA, 20 bp, Artificial sequence
  Synthetic oligonucleotide
tcagcttctcaatctttcct

SEQ ID NO: 2738 - DNA, 20 bp, Artificial sequence
  Synthetic oligonucleotide
ctccaccagcagcactactc

SEQ ID NO: 2739 - DNA, 20 bp, Artificial sequence
  Synthetic oligonucleotide
tacggaatatatagtattca

SEQ ID NO: 2740 - DNA, 20 bp, Artificial sequence
  Synthetic oligonucleotide
taagtgtcaaagaccctatt

SEQ ID NO: 2741 - DNA, 20 bp, Artificial sequence
  Synthetic oligonucleotide
acaagcccacatatgcaatt

SEQ ID NO: 2742 - DNA, 20 bp, Artificial sequence
  Synthetic oligonucleotide
ctgttctttggtttttcatg

SEQ ID NO: 2743 - DNA, 20 bp, Artificial sequence
  Synthetic oligonucleotide
ttattatccagtgtttttaa

SEQ ID NO: 2744 - DNA, 20 bp, Artificial sequence
  Synthetic oligonucleotide
cagtgttgcacataggttag

SEQ ID NO: 2745 - DNA, 20 bp, Artificial sequence
  Synthetic oligonucleotide
tttcacccccaatattaagt

SEQ ID NO: 2746 - DNA, 20 bp, Artificial sequence
  Synthetic oligonucleotide
ggtctcctctccatagggtt

SEQ ID NO: 2747 - DNA, 20 bp, Artificial sequence
  Synthetic oligonucleotide
cagtttggaatcttattaag

SEQ ID NO: 2748 - DNA, 20 bp, Artificial sequence
  Synthetic oligonucleotide
tgctggttccttacaattat

SEQ ID NO: 2749 - DNA, 20 bp, Artificial sequence
  Synthetic oligonucleotide
aagggttaattaggatctat

SEQ ID NO: 2750 - DNA, 20 bp, Artificial sequence
  Synthetic oligonucleotide
ttgtacattttaaccctttg

SEQ ID NO: 2751 - DNA, 20 bp, Artificial sequence
  Synthetic oligonucleotide
attttcctttctaagaagct

SEQ ID NO: 2752 - DNA, 20 bp, Artificial sequence
  Synthetic oligonucleotide
tttttatgttgctccttctt

SEQ ID NO: 2753 - DNA, 20 bp, Artificial sequence
  Synthetic oligonucleotide
tggtacacaggaaatacgca

SEQ ID NO: 2754 - DNA, 20 bp, Artificial sequence
  Synthetic oligonucleotide
tgccaaggacttcggagttt

SEQ ID NO: 2755 - DNA, 20 bp, Artificial sequence
  Synthetic oligonucleotide
gctctcaaagatagacccta

SEQ ID NO: 2756 - DNA, 20 bp, Artificial sequence
  Synthetic oligonucleotide
gctcacagctctgggaggag

SEQ ID NO: 2757 - DNA, 20 bp, Artificial sequence
  Synthetic oligonucleotide
atctagcaaaccctcttctt

SEQ ID NO: 2758 - DNA, 20 bp, Artificial sequence
  Synthetic oligonucleotide
agttcccattgcattgtttt

SEQ ID NO: 2759 - DNA, 20 bp, Artificial sequence
  Synthetic oligonucleotide
atcagttggaatgtaaaatg

SEQ ID NO: 2760 - DNA, 20 bp, Artificial sequence
  Synthetic oligonucleotide
taaaaatgggagcatggcaa

SEQ ID NO: 2761 - DNA, 20 bp, Artificial sequence
  Synthetic oligonucleotide
aaagctagtcaagtatacta

SEQ ID NO: 2762 - DNA, 20 bp, Artificial sequence
  Synthetic oligonucleotide
ccagttcctccagcacgagc

SEQ ID NO: 2763 - DNA, 20 bp, Artificial sequence
  Synthetic oligonucleotide
gcttattattctcacatata

SEQ ID NO: 2764 - DNA, 20 bp, Artificial sequence
  Synthetic oligonucleotide
agttacatgtaaccataatc

SEQ ID NO: 2765 - DNA, 20 bp, Artificial sequence
  Synthetic oligonucleotide
ataaaccaagttagtttgtc

SEQ ID NO: 2766 - DNA, 20 bp, Artificial sequence
  Synthetic oligonucleotide
ttcttctgtttgcattaaat

SEQ ID NO: 2767 - DNA, 20 bp, Artificial sequence
  Synthetic oligonucleotide
catgtatcctttaaaaagtg

SEQ ID NO: 2768 - DNA, 20 bp, Artificial sequence
  Synthetic oligonucleotide
aagcagcagattaaattagc

SEQ ID NO: 2769 - DNA, 20 bp, Artificial sequence
  Synthetic oligonucleotide
aaaactttagtcttcataaa

SEQ ID NO: 2770 - DNA, 20 bp, Artificial sequence
  Synthetic oligonucleotide
ggacaacatgatgggccagt

SEQ ID NO: 2771 - DNA, 20 bp, Artificial sequence
  Synthetic oligonucleotide
tgcttccagcttctagttac

SEQ ID NO: 2772 - DNA, 20 bp, Artificial sequence
  Synthetic oligonucleotide
caccaggcagtgaaaagaga

SEQ ID NO: 2773 - DNA, 20 bp, Artificial sequence
  Synthetic oligonucleotide
aactgctgtgtatttttctt

SEQ ID NO: 2774 - DNA, 20 bp, Artificial sequence
  Synthetic oligonucleotide
attagcatcattggcgcatg

SEQ ID NO: 2775 - DNA, 20 bp, Artificial sequence
  Synthetic oligonucleotide
ctagctgatgtgttcatgac

SEQ ID NO: 2776 - DNA, 20 bp, Artificial sequence
  Synthetic oligonucleotide
gaactgacaaccgcccgcca

SEQ ID NO: 2777 - DNA, 20 bp, Artificial sequence
  Synthetic oligonucleotide
ctaagtagtgtttgggatgc

SEQ ID NO: 2778 - DNA, 20 bp, Artificial sequence
  Synthetic oligonucleotide
caatgcaacttaataacctt

SEQ ID NO: 2779 - DNA, 20 bp, Artificial sequence
  Synthetic oligonucleotide
ctagcaagagccataaaaat

SEQ ID NO: 2780 - DNA, 20 bp, Artificial sequence
  Synthetic oligonucleotide
atcccttatgtagaagtata

SEQ ID NO: 2781 - DNA, 20 bp, Artificial sequence
  Synthetic oligonucleotide
tcaaagcttagagtttttgc

SEQ ID NO: 2782 - DNA, 20 bp, Artificial sequence
  Synthetic oligonucleotide
taaaaaggttgaggaccatt

SEQ ID NO: 2783 - DNA, 20 bp, Artificial sequence
  Synthetic oligonucleotide
tggtatacttgttgagctct

SEQ ID NO: 2784 - DNA, 20 bp, Artificial sequence
  Synthetic oligonucleotide
cattttgaattacaatgcgg

SEQ ID NO: 2785 - DNA, 20 bp, Artificial sequence
  Synthetic oligonucleotide
accagagccattccaactcc

SEQ ID NO: 2786 - DNA, 20 bp, Artificial sequence
  Synthetic oligonucleotide
gatcagggcccaggcctatg

SEQ ID NO: 2787 - DNA, 20 bp, Artificial sequence
  Synthetic oligonucleotide
acgctgtatttttactcacc

SEQ ID NO: 2788 - DNA, 20 bp, Artificial sequence
  Synthetic oligonucleotide
tgtatgccctgggagaataa

SEQ ID NO: 2789 - DNA, 20 bp, Artificial sequence
  Synthetic oligonucleotide
caaagactttgaaatctcac

SEQ ID NO: 2790 - DNA, 20 bp, Artificial sequence
  Synthetic oligonucleotide
atcaccggattgttttcttc

SEQ ID NO: 2791 - DNA, 20 bp, Artificial sequence
  Synthetic oligonucleotide
ctgaagtcttgttcagtgtc

SEQ ID NO: 2792 - DNA, 20 bp, Artificial sequence
  Synthetic oligonucleotide
ttccatacagatcgcatagc

SEQ ID NO: 2793 - DNA, 20 bp, Artificial sequence
  Synthetic oligonucleotide
tgttgttgtttacattatta

SEQ ID NO: 2794 - DNA, 20 bp, Artificial sequence
  Synthetic oligonucleotide
caatttcagacttcttgttg

SEQ ID NO: 2795 - DNA, 20 bp, Artificial sequence
  Synthetic oligonucleotide
ccctccagctattcacatgg

SEQ ID NO: 2796 - DNA, 20 bp, Artificial sequence
  Synthetic oligonucleotide
tctctttgcgcctgtgtcac

SEQ ID NO: 2797 - DNA, 20 bp, Artificial sequence
  Synthetic oligonucleotide
tcagtatttactacttctgc

SEQ ID NO: 2798 - DNA, 20 bp, Artificial sequence
  Synthetic oligonucleotide
gaagtcttccttcgattatc

SEQ ID NO: 2799 - DNA, 20 bp, Artificial sequence
  Synthetic oligonucleotide
attttatgagggactagagc

SEQ ID NO: 2800 - DNA, 20 bp, Artificial sequence
  Synthetic oligonucleotide
tcatttctaaataatatgcg

SEQ ID NO: 2801 - DNA, 20 bp, Artificial sequence
  Synthetic oligonucleotide
ttggttcagacgcaaccatg

SEQ ID NO: 2802 - DNA, 20 bp, Artificial sequence
  Synthetic oligonucleotide
agtatttgaaactgagaagt

SEQ ID NO: 2803 - DNA, 20 bp, Artificial sequence
  Synthetic oligonucleotide
ttagctcatcaaggtaccag

SEQ ID NO: 2804 - DNA, 20 bp, Artificial sequence
  Synthetic oligonucleotide
gactaaatttttaatataac

SEQ ID NO: 2805 - DNA, 20 bp, Artificial sequence
  Synthetic oligonucleotide
agtaagtctctaataaaaaa

SEQ ID NO: 2806 - DNA, 20 bp, Artificial sequence
  Synthetic oligonucleotide
gcagcggaaaatatgattta

SEQ ID NO: 2807 - DNA, 20 bp, Artificial sequence
  Synthetic oligonucleotide
ttcactaggttctcaaaagg

SEQ ID NO: 2808 - DNA, 20 bp, Artificial sequence
  Synthetic oligonucleotide
cactatcaagaccaaaaaga

SEQ ID NO: 2809 - DNA, 20 bp, Artificial sequence
  Synthetic oligonucleotide
tgtttaatcacagttttctc

SEQ ID NO: 2810 - DNA, 20 bp, Artificial sequence
  Synthetic oligonucleotide
aagatcaaaagaagttttag

SEQ ID NO: 2811 - DNA, 20 bp, Artificial sequence
  Synthetic oligonucleotide
aaaagcattctggaagagaa

SEQ ID NO: 2812 - DNA, 20 bp, Artificial sequence
  Synthetic oligonucleotide
ttaactgagttctataggtg

SEQ ID NO: 2813 - DNA, 20 bp, Artificial sequence
  Synthetic oligonucleotide
tagcaggcgatgttggagga

SEQ ID NO: 2814 - DNA, 20 bp, Artificial sequence
  Synthetic oligonucleotide
taggtgtgggtaggtatgag

SEQ ID NO: 2815 - DNA, 20 bp, Artificial sequence
  Synthetic oligonucleotide
tatgtgaagataaactgcta

SEQ ID NO: 2816 - DNA, 20 bp, Artificial sequence
  Synthetic oligonucleotide
aactcttctctaagtgtcaa

SEQ ID NO: 2817 - DNA, 20 bp, Artificial sequence
  Synthetic oligonucleotide
gccagtctcacagtgtcaac

SEQ ID NO: 2818 - DNA, 20 bp, Artificial sequence
  Synthetic oligonucleotide
tctctcactggctgttcttt

SEQ ID NO: 2819 - DNA, 20 bp, Artificial sequence
  Synthetic oligonucleotide
attttccatataaattatgt

SEQ ID NO: 2820 - DNA, 20 bp, Artificial sequence
  Synthetic oligonucleotide
atattaaccacagtgttgca

SEQ ID NO: 2821 - DNA, 20 bp, Artificial sequence
  Synthetic oligonucleotide
actaaaatctttcctcagtg

SEQ ID NO: 2822 - DNA, 20 bp, Artificial sequence
  Synthetic oligonucleotide
tctaagcgactgcttaataa

SEQ ID NO: 2823 - DNA, 20 bp, Artificial sequence
  Synthetic oligonucleotide
tcagtttggaatcttattaa

SEQ ID NO: 2824 - DNA, 20 bp, Artificial sequence
  Synthetic oligonucleotide
atgctggttccttacaatta

SEQ ID NO: 2825 - DNA, 20 bp, Artificial sequence
  Synthetic oligonucleotide
caaagggttaattaggatct

SEQ ID NO: 2826 - DNA, 20 bp, Artificial sequence
  Synthetic oligonucleotide
cttgtacattttaacccttt

SEQ ID NO: 2827 - DNA, 20 bp, Artificial sequence
  Synthetic oligonucleotide
tacactttaaacggtttatt

SEQ ID NO: 2828 - DNA, 20 bp, Artificial sequence
  Synthetic oligonucleotide
ctttttatgttgctccttct

SEQ ID NO: 2829 - DNA, 20 bp, Artificial sequence
  Synthetic oligonucleotide
gccctcttacttactagcca

SEQ ID NO: 2830 - DNA, 20 bp, Artificial sequence
  Synthetic oligonucleotide
attgccaaggacttcggagt

SEQ ID NO: 2831 - DNA, 20 bp, Artificial sequence
  Synthetic oligonucleotide
caaataggcccaatacatat

SEQ ID NO: 2832 - DNA, 20 bp, Artificial sequence
  Synthetic oligonucleotide
aattgtccatcccagtgatt

SEQ ID NO: 2833 - DNA, 20 bp, Artificial sequence
  Synthetic oligonucleotide
gttgcccctctgcttcaaaa

SEQ ID NO: 2834 - DNA, 20 bp, Artificial sequence
  Synthetic oligonucleotide
aaagttcccattgcattgtt

SEQ ID NO: 2835 - DNA, 20 bp, Artificial sequence
  Synthetic oligonucleotide
gacctgttgaaattaaaaag

SEQ ID NO: 2836 - DNA, 20 bp, Artificial sequence
  Synthetic oligonucleotide
gaattacattattatctatc

SEQ ID NO: 2837 - DNA, 20 bp, Artificial sequence
  Synthetic oligonucleotide
cttattaccttcctgtatat

SEQ ID NO: 2838 - DNA, 20 bp, Artificial sequence
  Synthetic oligonucleotide
tctgcatgtaagggcctcgc

SEQ ID NO: 2839 - DNA, 20 bp, Artificial sequence
  Synthetic oligonucleotide
ttgcttattattctcacata

SEQ ID NO: 2840 - DNA, 20 bp, Artificial sequence
  Synthetic oligonucleotide
tagttacatgtaaccataat

SEQ ID NO: 2841 - DNA, 20 bp, Artificial sequence
  Synthetic oligonucleotide
ataaaagccagcatgataaa

SEQ ID NO: 2842 - DNA, 20 bp, Artificial sequence
  Synthetic oligonucleotide
ctatgttttcaatgcctttg

SEQ ID NO: 2843 - DNA, 20 bp, Artificial sequence
  Synthetic oligonucleotide
aaaatattaggcatttccca

SEQ ID NO: 2844 - DNA, 20 bp, Artificial sequence
  Synthetic oligonucleotide
atttgtaactaggttttgtc

SEQ ID NO: 2845 - DNA, 20 bp, Artificial sequence
  Synthetic oligonucleotide
aattttatttgtaatactga

SEQ ID NO: 2846 - DNA, 20 bp, Artificial sequence
  Synthetic oligonucleotide
ttcaaaggacaacatgatgg

SEQ ID NO: 2847 - DNA, 20 bp, Artificial sequence
  Synthetic oligonucleotide
cttcagtgcagctccttctc

SEQ ID NO: 2848 - DNA, 20 bp, Artificial sequence
  Synthetic oligonucleotide
aaacagattacattaataag

SEQ ID NO: 2849 - DNA, 20 bp, Artificial sequence
  Synthetic oligonucleotide
gaactgctgtgtatttttct

SEQ ID NO: 2850 - DNA, 20 bp, Artificial sequence
  Synthetic oligonucleotide
gtcattagcatcattggcgc

SEQ ID NO: 2851 - DNA, 20 bp, Artificial sequence
  Synthetic oligonucleotide
gctagctgatgtgttcatga

SEQ ID NO: 2852 - DNA, 20 bp, Artificial sequence
  Synthetic oligonucleotide
ccttctccctttgaacacta

SEQ ID NO: 2853 - DNA, 20 bp, Artificial sequence
  Synthetic oligonucleotide
gctaagtagtgtttgggatg

SEQ ID NO: 2854 - DNA, 20 bp, Artificial sequence
  Synthetic oligonucleotide
tcaatgcaacttaataacct

SEQ ID NO: 2855 - DNA, 20 bp, Artificial sequence
  Synthetic oligonucleotide
cccacaatatttgacaaact

SEQ ID NO: 2856 - DNA, 20 bp, Artificial sequence
  Synthetic oligonucleotide
gctgtagctatttaggacaa

SEQ ID NO: 2857 - DNA, 20 bp, Artificial sequence
  Synthetic oligonucleotide
atgttagccagctggtgtac

SEQ ID NO: 2858 - DNA, 20 bp, Artificial sequence
  Synthetic oligonucleotide
aaaccggtccctagtgttaa

SEQ ID NO: 2859 - DNA, 20 bp, Artificial sequence
  Synthetic oligonucleotide
agtaatgcccttagggccta

SEQ ID NO: 2860 - DNA, 20 bp, Artificial sequence
  Synthetic oligonucleotide
acattttgaattacaatgcg

SEQ ID NO: 2861 - DNA, 20 bp, Artificial sequence
  Synthetic oligonucleotide
cccgtgatctgattcccatg

SEQ ID NO: 2862 - DNA, 20 bp, Artificial sequence
  Synthetic oligonucleotide
atgctcaaggaggagcaaga

SEQ ID NO: 2863 - DNA, 20 bp, Artificial sequence
  Synthetic oligonucleotide
tacgctgtatttttactcac

SEQ ID NO: 2864 - DNA, 20 bp, Artificial sequence
  Synthetic oligonucleotide
attatgtatgccctgggaga

SEQ ID NO: 2865 - DNA, 20 bp, Artificial sequence
  Synthetic oligonucleotide
gcaaagactttgaaatctca

SEQ ID NO: 2866 - DNA, 20 bp, Artificial sequence
  Synthetic oligonucleotide
aatcaccggattgttttctt

SEQ ID NO: 2867 - DNA, 20 bp, Artificial sequence
  Synthetic oligonucleotide
gctgaagtcttgttcagtgt

SEQ ID NO: 2868 - DNA, 20 bp, Artificial sequence
  Synthetic oligonucleotide
attccatacagatcgcatag

SEQ ID NO: 2869 - DNA, 20 bp, Artificial sequence
  Synthetic oligonucleotide
tcttgttgttgtttacatta

SEQ ID NO: 2870 - DNA, 20 bp, Artificial sequence
  Synthetic oligonucleotide
ccaatttcagacttcttgtt

SEQ ID NO: 2871 - DNA, 20 bp, Artificial sequence
  Synthetic oligonucleotide
gctcttccctccagctattc

SEQ ID NO: 2872 - DNA, 20 bp, Artificial sequence
  Synthetic oligonucleotide
ctctctttgcgcctgtgtca

SEQ ID NO: 2873 - DNA, 20 bp, Artificial sequence
  Synthetic oligonucleotide
aatcagtatttactacttct

SEQ ID NO: 2874 - DNA, 20 bp, Artificial sequence
  Synthetic oligonucleotide
tacaggtgagatatatagga

SEQ ID NO: 2875 - DNA, 20 bp, Artificial sequence
  Synthetic oligonucleotide
cattttatgagggactagag

SEQ ID NO: 2876 - DNA, 20 bp, Artificial sequence
  Synthetic oligonucleotide
accaatcactgttataaaga

SEQ ID NO: 2877 - DNA, 20 bp, Artificial sequence
  Synthetic oligonucleotide
aaattgtcatactgtattgt

SEQ ID NO: 2878 - DNA, 20 bp, Artificial sequence
  Synthetic oligonucleotide
ctgattacacaaaccagtct

SEQ ID NO: 2879 - DNA, 20 bp, Artificial sequence
  Synthetic oligonucleotide
tttagctcatcaaggtacca

SEQ ID NO: 2880 - DNA, 20 bp, Artificial sequence
  Synthetic oligonucleotide
tggcatatacaaataaataa

SEQ ID NO: 2881 - DNA, 20 bp, Artificial sequence
  Synthetic oligonucleotide
ttaaaccaggatccctagaa

SEQ ID NO: 2882 - DNA, 20 bp, Artificial sequence
  Synthetic oligonucleotide
cacattctgttacttcacca

SEQ ID NO: 2883 - DNA, 20 bp, Artificial sequence
  Synthetic oligonucleotide
tttcactaggttctcaaaag

SEQ ID NO: 2884 - DNA, 20 bp, Artificial sequence
  Synthetic oligonucleotide
acacatatctgtgtcttaat

SEQ ID NO: 2885 - DNA, 20 bp, Artificial sequence
  Synthetic oligonucleotide
ttgtttaatcacagttttct

SEQ ID NO: 2886 - DNA, 20 bp, Artificial sequence
  Synthetic oligonucleotide
ctccctatctcaaatgaatg

SEQ ID NO: 2887 - DNA, 20 bp, Artificial sequence
  Synthetic oligonucleotide
tgctgaactcttctgaggct

SEQ ID NO: 2888 - DNA, 20 bp, Artificial sequence
  Synthetic oligonucleotide
attaactgagttctataggt

SEQ ID NO: 2889 - DNA, 20 bp, Artificial sequence
  Synthetic oligonucleotide
aaaagcattgtaacaacaag

SEQ ID NO: 2890 - DNA, 20 bp, Artificial sequence
  Synthetic oligonucleotide
taacctcttcttatcccaaa

SEQ ID NO: 2891 - DNA, 20 bp, Artificial sequence
  Synthetic oligonucleotide
gaaacatttattgaacataa

SEQ ID NO: 2892 - DNA, 20 bp, Artificial sequence
  Synthetic oligonucleotide
gcttttcatcaggtgataaa

SEQ ID NO: 2893 - DNA, 20 bp, Artificial sequence
  Synthetic oligonucleotide
gctccaatatcggcaatgct

SEQ ID NO: 2894 - DNA, 20 bp, Artificial sequence
  Synthetic oligonucleotide
tttttgtccttcactttctc

SEQ ID NO: 2895 - DNA, 20 bp, Artificial sequence
  Synthetic oligonucleotide
aattttccatataaattatg

SEQ ID NO: 2896 - DNA, 20 bp, Artificial sequence
  Synthetic oligonucleotide
cctttcttgaagtaagcata

SEQ ID NO: 2897 - DNA, 20 bp, Artificial sequence
  Synthetic oligonucleotide
cagcccccttcaggtttttt

SEQ ID NO: 2898 - DNA, 20 bp, Artificial sequence
  Synthetic oligonucleotide
ttctaaataatttatacagt

SEQ ID NO: 2899 - DNA, 20 bp, Artificial sequence
  Synthetic oligonucleotide
ctcagtttggaatcttatta

SEQ ID NO: 2900 - DNA, 20 bp, Artificial sequence
  Synthetic oligonucleotide
aatgctggttccttacaatt

SEQ ID NO: 2901 - DNA, 20 bp, Artificial sequence
  Synthetic oligonucleotide
cccaaagggttaattaggat

SEQ ID NO: 2902 - DNA, 20 bp, Artificial sequence
  Synthetic oligonucleotide
tcttgtacattttaaccctt

SEQ ID NO: 2903 - DNA, 20 bp, Artificial sequence
  Synthetic oligonucleotide
ttaaaatcaactgagaagac

SEQ ID NO: 2904 - DNA, 20 bp, Artificial sequence
  Synthetic oligonucleotide
actttttatgttgctccttc

SEQ ID NO: 2905 - DNA, 20 bp, Artificial sequence
  Synthetic oligonucleotide
cttaaacaccagatggtcag

SEQ ID NO: 2906 - DNA, 20 bp, Artificial sequence
  Synthetic oligonucleotide
atagctaaagagtcaagtgg

SEQ ID NO: 2907 - DNA, 20 bp, Artificial sequence
  Synthetic oligonucleotide
agaggaagtaaaaaagaagg

SEQ ID NO: 2908 - DNA, 20 bp, Artificial sequence
  Synthetic oligonucleotide
aactgcccctccaacacccc

SEQ ID NO: 2909 - DNA, 20 bp, Artificial sequence
  Synthetic oligonucleotide
agcacagaatactagtttat

SEQ ID NO: 2910 - DNA, 20 bp, Artificial sequence
  Synthetic oligonucleotide
aaaagttcccattgcattgt

SEQ ID NO: 2911 - DNA, 20 bp, Artificial sequence
  Synthetic oligonucleotide
tgatgaggtgctcctggatc

SEQ ID NO: 2912 - DNA, 20 bp, Artificial sequence
  Synthetic oligonucleotide
atcagtttgtatgaccataa

SEQ ID NO: 2913 - DNA, 20 bp, Artificial sequence
  Synthetic oligonucleotide
acttattaccttcctgtata

SEQ ID NO: 2914 - DNA, 20 bp, Artificial sequence
  Synthetic oligonucleotide
ggcactgcattcattttgag

SEQ ID NO: 2915 - DNA, 20 bp, Artificial sequence
  Synthetic oligonucleotide
tttgcttattattctcacat

SEQ ID NO: 2916 - DNA, 20 bp, Artificial sequence
  Synthetic oligonucleotide
gtagttacatgtaaccataa

SEQ ID NO: 2917 - DNA, 20 bp, Artificial sequence
  Synthetic oligonucleotide
attgttaaaatatatacaag

SEQ ID NO: 2918 - DNA, 20 bp, Artificial sequence
  Synthetic oligonucleotide
gcagtcattagtggtcctat

SEQ ID NO: 2919 - DNA, 20 bp, Artificial sequence
  Synthetic oligonucleotide
ataaatttcatcttatcaga

SEQ ID NO: 2920 - DNA, 20 bp, Artificial sequence
  Synthetic oligonucleotide
aatttgtaactaggttttgt

SEQ ID NO: 2921 - DNA, 20 bp, Artificial sequence
  Synthetic oligonucleotide
tatactttaaatcaatacta

SEQ ID NO: 2922 - DNA, 20 bp, Artificial sequence
  Synthetic oligonucleotide
cttctgccactcagtttact

SEQ ID NO: 2923 - DNA, 20 bp, Artificial sequence
  Synthetic oligonucleotide
ggaaatggaattcattgtgg

SEQ ID NO: 2924 - DNA, 20 bp, Artificial sequence
  Synthetic oligonucleotide
attagacactggatccaagg

SEQ ID NO: 2925 - DNA, 20 bp, Artificial sequence
  Synthetic oligonucleotide
ctgttcgatgcaggactagc

SEQ ID NO: 2926 - DNA, 20 bp, Artificial sequence
  Synthetic oligonucleotide
ttcatgactttcaagggtta

SEQ ID NO: 2927 - DNA, 20 bp, Artificial sequence
  Synthetic oligonucleotide
ttcttttgctagctgatgtg

SEQ ID NO: 2928 - DNA, 20 bp, Artificial sequence
  Synthetic oligonucleotide
tccttctccctttgaacact

SEQ ID NO: 2929 - DNA, 20 bp, Artificial sequence
  Synthetic oligonucleotide
ggctaagtagtgtttgggat

SEQ ID NO: 2930 - DNA, 20 bp, Artificial sequence
  Synthetic oligonucleotide
gtcaatgcaacttaataacc

SEQ ID NO: 2931 - DNA, 20 bp, Artificial sequence
  Synthetic oligonucleotide
tcctttaaaaattccccaca

SEQ ID NO: 2932 - DNA, 20 bp, Artificial sequence
  Synthetic oligonucleotide
aatagggttttgttcatgct

SEQ ID NO: 2933 - DNA, 20 bp, Artificial sequence
  Synthetic oligonucleotide
tgatcttgtgtatatattac

SEQ ID NO: 2934 - DNA, 20 bp, Artificial sequence
  Synthetic oligonucleotide
gactgtattccataaaacaa

SEQ ID NO: 2935 - DNA, 20 bp, Artificial sequence
  Synthetic oligonucleotide
ctataaaacagtaatgccct

SEQ ID NO: 2936 - DNA, 20 bp, Artificial sequence
  Synthetic oligonucleotide
tacattttgaattacaatgc

SEQ ID NO: 2937 - DNA, 20 bp, Artificial sequence
  Synthetic oligonucleotide
attacgaccattctgctcag

SEQ ID NO: 2938 - DNA, 20 bp, Artificial sequence
  Synthetic oligonucleotide
caaacctcttcactcctgcc

SEQ ID NO: 2939 - DNA, 20 bp, Artificial sequence
  Synthetic oligonucleotide
ttacgctgtatttttactca

SEQ ID NO: 2940 - DNA, 20 bp, Artificial sequence
  Synthetic oligonucleotide
tttcttttccgtttttcata

SEQ ID NO: 2941 - DNA, 20 bp, Artificial sequence
  Synthetic oligonucleotide
agcaaagactttgaaatctc

SEQ ID NO: 2942 - DNA, 20 bp, Artificial sequence
  Synthetic oligonucleotide
tataaacaaactttttgatt

SEQ ID NO: 2943 - DNA, 20 bp, Artificial sequence
  Synthetic oligonucleotide
ggaattattctctcaactat

SEQ ID NO: 2944 - DNA, 20 bp, Artificial sequence
  Synthetic oligonucleotide
tattccatacagatcgcata

SEQ ID NO: 2945 - DNA, 20 bp, Artificial sequence
  Synthetic oligonucleotide
ttcttgttgttgtttacatt

SEQ ID NO: 2946 - DNA, 20 bp, Artificial sequence
  Synthetic oligonucleotide
tccaatttcagacttcttgt

SEQ ID NO: 2947 - DNA, 20 bp, Artificial sequence
  Synthetic oligonucleotide
aatatacacaaacaatctaa

SEQ ID NO: 2948 - DNA, 20 bp, Artificial sequence
  Synthetic oligonucleotide
gctctctttgcgcctgtgtc

SEQ ID NO: 2949 - DNA, 20 bp, Artificial sequence
  Synthetic oligonucleotide
gaatcagtatttactacttc

SEQ ID NO: 2950 - DNA, 20 bp, Artificial sequence
  Synthetic oligonucleotide
gtctacaaaataacctgtaa

SEQ ID NO: 2951 - DNA, 20 bp, Artificial sequence
  Synthetic oligonucleotide
aatgatgctttcaaaggcac

SEQ ID NO: 2952 - DNA, 20 bp, Artificial sequence
  Synthetic oligonucleotide
ttatagccaggcatgtggca

SEQ ID NO: 2953 - DNA, 20 bp, Artificial sequence
  Synthetic oligonucleotide
taaattgtcatactgtattg

SEQ ID NO: 2954 - DNA, 20 bp, Artificial sequence
  Synthetic oligonucleotide
ctatggtttgtcttaagtac

SEQ ID NO: 2955 - DNA, 20 bp, Artificial sequence
  Synthetic oligonucleotide
ctttagctcatcaaggtacc

SEQ ID NO: 2956 - DNA, 20 bp, Artificial sequence
  Synthetic oligonucleotide
ataaaaacagcttttggtat

SEQ ID NO: 2957 - DNA, 20 bp, Artificial sequence
  Synthetic oligonucleotide
aaggccacagaacagagcca

SEQ ID NO: 2958 - DNA, 20 bp, Artificial sequence
  Synthetic oligonucleotide
tggtcatgaataagaatcgc

SEQ ID NO: 2959 - DNA, 20 bp, Artificial sequence
  Synthetic oligonucleotide
gtttcactaggttctcaaaa

SEQ ID NO: 2960 - DNA, 20 bp, Artificial sequence
  Synthetic oligonucleotide
ccagaatgaacacatatctg

SEQ ID NO: 2961 - DNA, 20 bp, Artificial sequence
  Synthetic oligonucleotide
tttgtttaatcacagttttc

SEQ ID NO: 2962 - DNA, 20 bp, Artificial sequence
  Synthetic oligonucleotide
aggaggctaaggtgaatcac

SEQ ID NO: 2963 - DNA, 20 bp, Artificial sequence
  Synthetic oligonucleotide
aaataggtgagggactggaa

SEQ ID NO: 2964 - DNA, 20 bp, Artificial sequence
  Synthetic oligonucleotide
aattaactgagttctatagg

SEQ ID NO: 2965 - DNA, 20 bp, Artificial sequence
  Synthetic oligonucleotide
actatgcccagcaagtctgg

SEQ ID NO: 2966 - DNA, 20 bp, Artificial sequence
  Synthetic oligonucleotide
cttctataactgtcattgtc

SEQ ID NO: 2967 - DNA, 20 bp, Artificial sequence
  Synthetic oligonucleotide
gaaagtttatataatctggc

SEQ ID NO: 2968 - DNA, 20 bp, Artificial sequence
  Synthetic oligonucleotide
agatcctgtgttccagacac

SEQ ID NO: 2969 - DNA, 20 bp, Artificial sequence
  Synthetic oligonucleotide
ggctccaatatcggcaatgc

SEQ ID NO: 2970 - DNA, 20 bp, Artificial sequence
  Synthetic oligonucleotide
tccatcaatcttggtctatc

SEQ ID NO: 2971 - DNA, 20 bp, Artificial sequence
  Synthetic oligonucleotide
cataggttagaattttccat

SEQ ID NO: 2972 - DNA, 20 bp, Artificial sequence
  Synthetic oligonucleotide
tcatgtcttgtattataagt

SEQ ID NO: 2973 - DNA, 20 bp, Artificial sequence
  Synthetic oligonucleotide
atatatttctcagccccctt

SEQ ID NO: 2974 - DNA, 20 bp, Artificial sequence
  Synthetic oligonucleotide
gataatattcattgctattt

SEQ ID NO: 2975 - DNA, 20 bp, Artificial sequence
  Synthetic oligonucleotide
actcagtttggaatcttatt

SEQ ID NO: 2976 - DNA, 20 bp, Artificial sequence
  Synthetic oligonucleotide
aaatgctggttccttacaat

SEQ ID NO: 2977 - DNA, 20 bp, Artificial sequence
  Synthetic oligonucleotide
ttaacctccttaagattaag

SEQ ID NO: 2978 - DNA, 20 bp, Artificial sequence
  Synthetic oligonucleotide
ttcttgtacattttaaccct

SEQ ID NO: 2979 - DNA, 20 bp, Artificial sequence
  Synthetic oligonucleotide
taacggttgcttagggttgg

SEQ ID NO: 2980 - DNA, 20 bp, Artificial sequence
  Synthetic oligonucleotide
gactttttatgttgctcctt

SEQ ID NO: 2981 - DNA, 20 bp, Artificial sequence
  Synthetic oligonucleotide
aaatgaaggactacagatat

SEQ ID NO: 2982 - DNA, 20 bp, Artificial sequence
  Synthetic oligonucleotide
gcatcgcaagctttactgca

SEQ ID NO: 2983 - DNA, 20 bp, Artificial sequence
  Synthetic oligonucleotide
ggagcgaagaggaagtaaaa

SEQ ID NO: 2984 - DNA, 20 bp, Artificial sequence
  Synthetic oligonucleotide
gtcattaagtaggtgaattc

SEQ ID NO: 2985 - DNA, 20 bp, Artificial sequence
  Synthetic oligonucleotide
tgagaaatgtcttttctgta

SEQ ID NO: 2986 - DNA, 20 bp, Artificial sequence
  Synthetic oligonucleotide
aaaaagttcccattgcattg

SEQ ID NO: 2987 - DNA, 20 bp, Artificial sequence
  Synthetic oligonucleotide
aaactgttggctcaaatgat

SEQ ID NO: 2988 - DNA, 20 bp, Artificial sequence
  Synthetic oligonucleotide
aaggtagtcctattagatta

SEQ ID NO: 2989 - DNA, 20 bp, Artificial sequence
  Synthetic oligonucleotide
tacttattaccttcctgtat

SEQ ID NO: 2990 - DNA, 20 bp, Artificial sequence
  Synthetic oligonucleotide
ctcagcctcaaacaccagtt

SEQ ID NO: 2991 - DNA, 20 bp, Artificial sequence
  Synthetic oligonucleotide
ttttgcttattattctcaca

SEQ ID NO: 2992 - DNA, 20 bp, Artificial sequence
  Synthetic oligonucleotide
tgtagttacatgtaaccata

SEQ ID NO: 2993 - DNA, 20 bp, Artificial sequence
  Synthetic oligonucleotide
gtctcaaaagcatgcataca

SEQ ID NO: 2994 - DNA, 20 bp, Artificial sequence
  Synthetic oligonucleotide
gaataaaataattatcctat

SEQ ID NO: 2995 - DNA, 20 bp, Artificial sequence
  Synthetic oligonucleotide
aggcataaatttcatcttat

SEQ ID NO: 2996 - DNA, 20 bp, Artificial sequence
  Synthetic oligonucleotide
taatttgtaactaggttttg

SEQ ID NO: 2997 - DNA, 20 bp, Artificial sequence
  Synthetic oligonucleotide
gctgagtgaatgtacatagg

SEQ ID NO: 2998 - DNA, 20 bp, Artificial sequence
  Synthetic oligonucleotide
aaggaccacagtctctctca

SEQ ID NO: 2999 - DNA, 20 bp, Artificial sequence
  Synthetic oligonucleotide
aacttcccagagctgtggaa

SEQ ID NO: 3000 - DNA, 20 bp, Artificial sequence
  Synthetic oligonucleotide
ggactctcaggaaagggcaa

SEQ ID NO: 3001 - DNA, 20 bp, Artificial sequence
  Synthetic oligonucleotide
cttttctcatgtgcggcatc

SEQ ID NO: 3002 - DNA, 20 bp, Artificial sequence
  Synthetic oligonucleotide
tgatgtttcattgggtttaa

SEQ ID NO: 3003 - DNA, 20 bp, Artificial sequence
  Synthetic oligonucleotide
atgtgttcatgactttcaag

SEQ ID NO: 3004 - DNA, 20 bp, Artificial sequence
  Synthetic oligonucleotide
gttacttcttttgctagctg

SEQ ID NO: 3005 - DNA, 20 bp, Artificial sequence
  Synthetic oligonucleotide
ctaacttctcccctccagag

SEQ ID NO: 3006 - DNA, 20 bp, Artificial sequence
  Synthetic oligonucleotide
gtgtttgggatgcttcagac

SEQ ID NO: 3007 - DNA, 20 bp, Artificial sequence
  Synthetic oligonucleotide
acttaataaccttagtttta

SEQ ID NO: 3008 - DNA, 20 bp, Artificial sequence
  Synthetic oligonucleotide
gaatgctgcattttttttca

SEQ ID NO: 3009 - DNA, 20 bp, Artificial sequence
  Synthetic oligonucleotide
taagttgcaatgcctcaaga

SEQ ID NO: 3010 - DNA, 20 bp, Artificial sequence
  Synthetic oligonucleotide
tagagtttttgccttccatt

SEQ ID NO: 3011 - DNA, 20 bp, Artificial sequence
  Synthetic oligonucleotide
agcatgatcttgtgtatata

SEQ ID NO: 3012 - DNA, 20 bp, Artificial sequence
  Synthetic oligonucleotide
ggcacgaaactgacattttc

SEQ ID NO: 3013 - DNA, 20 bp, Artificial sequence
  Synthetic oligonucleotide
aattacaatgcggtatatat

SEQ ID NO: 3014 - DNA, 20 bp, Artificial sequence
  Synthetic oligonucleotide
cagtatctcagttttttttt

SEQ ID NO: 3015 - DNA, 20 bp, Artificial sequence
  Synthetic oligonucleotide
cgcatcattacgaccattct

SEQ ID NO: 3016 - DNA, 20 bp, Artificial sequence
  Synthetic oligonucleotide
aacatagtttctcatcacca

SEQ ID NO: 3017 - DNA, 20 bp, Artificial sequence
  Synthetic oligonucleotide
ctggccacgacaagttaatt

SEQ ID NO: 3018 - DNA, 20 bp, Artificial sequence
  Synthetic oligonucleotide
atctctttgacctaaaggca

SEQ ID NO: 3019 - DNA, 20 bp, Artificial sequence
  Synthetic oligonucleotide
gattgttttcttcattattg

SEQ ID NO: 3020 - DNA, 20 bp, Artificial sequence
  Synthetic oligonucleotide
cttgttcagtgtccttctag

SEQ ID NO: 3021 - DNA, 20 bp, Artificial sequence
  Synthetic oligonucleotide
gggattaggatgccaaatag

SEQ ID NO: 3022 - DNA, 20 bp, Artificial sequence
  Synthetic oligonucleotide
agtaatattccatacagatc

SEQ ID NO: 3023 - DNA, 20 bp, Artificial sequence
  Synthetic oligonucleotide
agacttcttgttgttgttta

SEQ ID NO: 3024 - DNA, 20 bp, Artificial sequence
  Synthetic oligonucleotide
ttcttccaatttcagacttc

SEQ ID NO: 3025 - DNA, 20 bp, Artificial sequence
  Synthetic oligonucleotide
accaggaaattgcttctaat

SEQ ID NO: 3026 - DNA, 20 bp, Artificial sequence
  Synthetic oligonucleotide
catgtgctctctttgcgcct

SEQ ID NO: 3027 - DNA, 20 bp, Artificial sequence
  Synthetic oligonucleotide
atatggccctagagcctaaa

SEQ ID NO: 3028 - DNA, 20 bp, Artificial sequence
  Synthetic oligonucleotide
agggactagagcatccataa

SEQ ID NO: 3029 - DNA, 20 bp, Artificial sequence
  Synthetic oligonucleotide
aacaaaggccaagagcatat

SEQ ID NO: 3030 - DNA, 20 bp, Artificial sequence
  Synthetic oligonucleotide
atggaattactttattctac

SEQ ID NO: 3031 - DNA, 20 bp, Artificial sequence
  Synthetic oligonucleotide
caaaacattaacaatacact

SEQ ID NO: 3032 - DNA, 20 bp, Artificial sequence
  Synthetic oligonucleotide
atcaaggtaccagttcttat

SEQ ID NO: 3033 - DNA, 20 bp, Artificial sequence
  Synthetic oligonucleotide
accaaatcacactaaaatga

SEQ ID NO: 3034 - DNA, 20 bp, Artificial sequence
  Synthetic oligonucleotide
agtagggaaccttttttttt

SEQ ID NO: 3035 - DNA, 20 bp, Artificial sequence
  Synthetic oligonucleotide
acaacaaaccaaaccacata

SEQ ID NO: 3036 - DNA, 20 bp, Artificial sequence
  Synthetic oligonucleotide
ctagaaaggcagatgttgaa

SEQ ID NO: 3037 - DNA, 20 bp, Artificial sequence
  Synthetic oligonucleotide
tacacagtttcactaggttc

SEQ ID NO: 3038 - DNA, 20 bp, Artificial sequence
  Synthetic oligonucleotide
tgaagttattgttctgactt

SEQ ID NO: 3039 - DNA, 20 bp, Artificial sequence
  Synthetic oligonucleotide
tttctcacatttaccattca

SEQ ID NO: 3040 - DNA, 20 bp, Artificial sequence
  Synthetic oligonucleotide
aaaaaactgacctattctat

SEQ ID NO: 3041 - DNA, 20 bp, Artificial sequence
  Synthetic oligonucleotide
agttctataggtgcttaagt

SEQ ID NO: 3042 - DNA, 20 bp, Artificial sequence
  Synthetic oligonucleotide
gaatactcatctgttctaac

SEQ ID NO: 3043 - DNA, 20 bp, Artificial sequence
  Synthetic oligonucleotide
tgaaaagcacacatttaagt

SEQ ID NO: 3044 - DNA, 20 bp, Artificial sequence
  Synthetic oligonucleotide
gtctcagaaagttcaggtag

SEQ ID NO: 3045 - DNA, 20 bp, Artificial sequence
  Synthetic oligonucleotide
tctacttgcattctctacct

SEQ ID NO: 3046 - DNA, 20 bp, Artificial sequence
  Synthetic oligonucleotide
tattcaccccatctccttcc

SEQ ID NO: 3047 - DNA, 20 bp, Artificial sequence
  Synthetic oligonucleotide
ttcatggctccaatatcggc

SEQ ID NO: 3048 - DNA, 20 bp, Artificial sequence
  Synthetic oligonucleotide
ttattttccctgaaaatgag

SEQ ID NO: 3049 - DNA, 20 bp, Artificial sequence
  Synthetic oligonucleotide
tgcacataggttagaatttt

SEQ ID NO: 3050 - DNA, 20 bp, Artificial sequence
  Synthetic oligonucleotide
tattgctattactatttcca

SEQ ID NO: 3051 - DNA, 20 bp, Artificial sequence
  Synthetic oligonucleotide
tatcatatatttctcagccc

SEQ ID NO: 3052 - DNA, 20 bp, Artificial sequence
  Synthetic oligonucleotide
ggaatcttattaagcaagtc

SEQ ID NO: 3053 - DNA, 20 bp, Artificial sequence
  Synthetic oligonucleotide
tccttacaattatctatgat

SEQ ID NO: 3054 - DNA, 20 bp, Artificial sequence
  Synthetic oligonucleotide
taattaggatctatacacac

SEQ ID NO: 3055 - DNA, 20 bp, Artificial sequence
  Synthetic oligonucleotide
attttaaccctttgaggaca

SEQ ID NO: 3056 - DNA, 20 bp, Artificial sequence
  Synthetic oligonucleotide
taaaactcaaattcatcagt

SEQ ID NO: 3057 - DNA, 20 bp, Artificial sequence
  Synthetic oligonucleotide
ggacttgtacacacaatata

SEQ ID NO: 3058 - DNA, 20 bp, Artificial sequence
  Synthetic oligonucleotide
gataagactttttatgttgc

SEQ ID NO: 3059 - DNA, 20 bp, Artificial sequence
  Synthetic oligonucleotide
taaacactttataggcaata

SEQ ID NO: 3060 - DNA, 20 bp, Artificial sequence
  Synthetic oligonucleotide
ttaaactcccagggacatta

SEQ ID NO: 3061 - DNA, 20 bp, Artificial sequence
  Synthetic oligonucleotide
attcccaagtgataagagat

SEQ ID NO: 3062 - DNA, 20 bp, Artificial sequence
  Synthetic oligonucleotide
ctatagaaaaagcaacctat

SEQ ID NO: 3063 - DNA, 20 bp, Artificial sequence
  Synthetic oligonucleotide
ctacacctgctggtgataca

SEQ ID NO: 3064 - DNA, 20 bp, Artificial sequence
  Synthetic oligonucleotide
aatctaaggccacatgaaaa

SEQ ID NO: 3065 - DNA, 20 bp, Artificial sequence
  Synthetic oligonucleotide
agtaacagcaataaagagag

SEQ ID NO: 3066 - DNA, 20 bp, Artificial sequence
  Synthetic oligonucleotide
actatcagtttacaaagatt

SEQ ID NO: 3067 - DNA, 20 bp, Artificial sequence
  Synthetic oligonucleotide
tttgttacttattaccttcc

SEQ ID NO: 3068 - DNA, 20 bp, Artificial sequence
  Synthetic oligonucleotide
tccacaaagatgctttgcca

SEQ ID NO: 3069 - DNA, 20 bp, Artificial sequence
  Synthetic oligonucleotide
taagttgatctacacaaatt

SEQ ID NO: 3070 - DNA, 20 bp, Artificial sequence
  Synthetic oligonucleotide
gcccatgtagttacatgtaa

SEQ ID NO: 3071 - DNA, 20 bp, Artificial sequence
  Synthetic oligonucleotide
gtagttcagatttggctgag

SEQ ID NO: 3072 - DNA, 20 bp, Artificial sequence
  Synthetic oligonucleotide
aaaaacattactaatggaaa

SEQ ID NO: 3073 - DNA, 20 bp, Artificial sequence
  Synthetic oligonucleotide
tagtactccttcctatttaa

SEQ ID NO: 3074 - DNA, 20 bp, Artificial sequence
  Synthetic oligonucleotide
gtgtttaatttgtaactagg

SEQ ID NO: 3075 - DNA, 20 bp, Artificial sequence
  Synthetic oligonucleotide
atacactgggaaaattttcc

SEQ ID NO: 3076 - DNA, 20 bp, Artificial sequence
  Synthetic oligonucleotide
ctagctgggagagcctctag

SEQ ID NO: 3077 - DNA, 20 bp, Artificial sequence
  Synthetic oligonucleotide
agcctctggtagacacctac

SEQ ID NO: 3078 - DNA, 20 bp, Artificial sequence
  Synthetic oligonucleotide
ttctgctaactggtttgccc

SEQ ID NO: 3079 - DNA, 20 bp, Artificial sequence
  Synthetic oligonucleotide
ttgttgtatggtaatttggg

SEQ ID NO: 3080 - DNA, 20 bp, Artificial sequence
  Synthetic oligonucleotide
tgatgtgttcatgactttca

SEQ ID NO: 3081 - DNA, 20 bp, Artificial sequence
  Synthetic oligonucleotide
ttgttacttcttttgctagc

SEQ ID NO: 3082 - DNA, 20 bp, Artificial sequence
  Synthetic oligonucleotide
atctccagggtccagcctgg

SEQ ID NO: 3083 - DNA, 20 bp, Artificial sequence
  Synthetic oligonucleotide
tagtgtttgggatgcttcag

SEQ ID NO: 3084 - DNA, 20 bp, Artificial sequence
  Synthetic oligonucleotide
caacttaataaccttagttt

SEQ ID NO: 3085 - DNA, 20 bp, Artificial sequence
  Synthetic oligonucleotide
aataaatcacttctgaaagt

SEQ ID NO: 3086 - DNA, 20 bp, Artificial sequence
  Synthetic oligonucleotide
gtaaactccaaaaggacaat

SEQ ID NO: 3087 - DNA, 20 bp, Artificial sequence
  Synthetic oligonucleotide
cttagagtttttgccttcca

SEQ ID NO: 3088 - DNA, 20 bp, Artificial sequence
  Synthetic oligonucleotide
cacagcatgatcttgtgtat

SEQ ID NO: 3089 - DNA, 20 bp, Artificial sequence
  Synthetic oligonucleotide
agttctgatacagttaataa

SEQ ID NO: 3090 - DNA, 20 bp, Artificial sequence
  Synthetic oligonucleotide
tgaattacaatgcggtatat

SEQ ID NO: 3091 - DNA, 20 bp, Artificial sequence
  Synthetic oligonucleotide
gccagtatctcagttttttt

SEQ ID NO: 3092 - DNA, 20 bp, Artificial sequence
  Synthetic oligonucleotide
tgcgcatcattacgaccatt

SEQ ID NO: 3093 - DNA, 20 bp, Artificial sequence
  Synthetic oligonucleotide
gtatttttactcaccttttc

SEQ ID NO: 3094 - DNA, 20 bp, Artificial sequence
  Synthetic oligonucleotide
aaaccaaaccaatagtctgg

SEQ ID NO: 3095 - DNA, 20 bp, Artificial sequence
  Synthetic oligonucleotide
actttgaaatctcacaaggt

SEQ ID NO: 3096 - DNA, 20 bp, Artificial sequence
  Synthetic oligonucleotide
cggattgttttcttcattat

SEQ ID NO: 3097 - DNA, 20 bp, Artificial sequence
  Synthetic oligonucleotide
gtcttgttcagtgtccttct

SEQ ID NO: 3098 - DNA, 20 bp, Artificial sequence
  Synthetic oligonucleotide
aatcctcttccatccccttt

SEQ ID NO: 3099 - DNA, 20 bp, Artificial sequence
  Synthetic oligonucleotide
taagtaatattccatacaga

SEQ ID NO: 3100 - DNA, 20 bp, Artificial sequence
  Synthetic oligonucleotide
ttcagacttcttgttgttgt

SEQ ID NO: 3101 - DNA, 20 bp, Artificial sequence
  Synthetic oligonucleotide
tgttcttccaatttcagact

SEQ ID NO: 3102 - DNA, 20 bp, Artificial sequence
  Synthetic oligonucleotide
gttatgactactccacgaac

SEQ ID NO: 3103 - DNA, 20 bp, Artificial sequence
  Synthetic oligonucleotide
tatttactacttctgcatgg

SEQ ID NO: 3104 - DNA, 20 bp, Artificial sequence
  Synthetic oligonucleotide
acttggtcaggaactcttgg

SEQ ID NO: 3105 - DNA, 20 bp, Artificial sequence
  Synthetic oligonucleotide
tgagggactagagcatccat

SEQ ID NO: 3106 - DNA, 20 bp, Artificial sequence
  Synthetic oligonucleotide
catatcgaagcagtattctc

SEQ ID NO: 3107 - DNA, 20 bp, Artificial sequence
  Synthetic oligonucleotide
attagactggataaaaggag

SEQ ID NO: 3108 - DNA, 20 bp, Artificial sequence
  Synthetic oligonucleotide
actttttatacctcatcagg

SEQ ID NO: 3109 - DNA, 20 bp, Artificial sequence
  Synthetic oligonucleotide
tcatcaaggtaccagttctt

SEQ ID NO: 3110 - DNA, 20 bp, Artificial sequence
  Synthetic oligonucleotide
atcagtagcattcttgacca

SEQ ID NO: 3111 - DNA, 20 bp, Artificial sequence
  Synthetic oligonucleotide
gtattttcttgcctttctat

SEQ ID NO: 3112 - DNA, 20 bp, Artificial sequence
  Synthetic oligonucleotide
gtttctcagtaaatcaaact

SEQ ID NO: 3113 - DNA, 20 bp, Artificial sequence
  Synthetic oligonucleotide
atacagaagaggaaattctg

SEQ ID NO: 3114 - DNA, 20 bp, Artificial sequence
  Synthetic oligonucleotide
ggtacacagtttcactaggt

SEQ ID NO: 3115 - DNA, 20 bp, Artificial sequence
  Synthetic oligonucleotide
tctccttcagctgtgtcttc

SEQ ID NO: 3116 - DNA, 20 bp, Artificial sequence
  Synthetic oligonucleotide
cagtcttactgaaaatgtcc

SEQ ID NO: 3117 - DNA, 20 bp, Artificial sequence
  Synthetic oligonucleotide
atatatatgttgaacacctg

SEQ ID NO: 3118 - DNA, 20 bp, Artificial sequence
  Synthetic oligonucleotide
tgagttctataggtgcttaa

SEQ ID NO: 3119 - DNA, 20 bp, Artificial sequence
  Synthetic oligonucleotide
taacatcacaaaccctcaaa

SEQ ID NO: 3120 - DNA, 20 bp, Artificial sequence
  Synthetic oligonucleotide
tttgatactaacctgaatca

SEQ ID NO: 3121 - DNA, 20 bp, Artificial sequence
  Synthetic oligonucleotide
agatataccttcggagtact

SEQ ID NO: 3122 - DNA, 20 bp, Artificial sequence
  Synthetic oligonucleotide
agataactattttaacaagc

SEQ ID NO: 3123 - DNA, 20 bp, Artificial sequence
  Synthetic oligonucleotide
gcactaactgttctctgtgt

SEQ ID NO: 3124 - DNA, 20 bp, Artificial sequence
  Synthetic oligonucleotide
ttttcatggctccaatatcg

SEQ ID NO: 3125 - DNA, 20 bp, Artificial sequence
  Synthetic oligonucleotide
aaactattttatcaatgata

SEQ ID NO: 3126 - DNA, 20 bp, Artificial sequence
  Synthetic oligonucleotide
tgttgcacataggttagaat

SEQ ID NO: 3127 - DNA, 20 bp, Artificial sequence
  Synthetic oligonucleotide
tagctaaaattgaatgtcca

SEQ ID NO: 3128 - DNA, 20 bp, Artificial sequence
  Synthetic oligonucleotide
taagtatcatatatttctca

SEQ ID NO: 3129 - DNA, 20 bp, Artificial sequence
  Synthetic oligonucleotide
ttggaatcttattaagcaag

SEQ ID NO: 3130 - DNA, 20 bp, Artificial sequence
  Synthetic oligonucleotide
gttccttacaattatctatg

SEQ ID NO: 3131 - DNA, 20 bp, Artificial sequence
  Synthetic oligonucleotide
gttaattaggatctatacac

SEQ ID NO: 3132 - DNA, 20 bp, Artificial sequence
  Synthetic oligonucleotide
acattttaaccctttgagga

SEQ ID NO: 3133 - DNA, 20 bp, Artificial sequence
  Synthetic oligonucleotide
taggcaaagaccactttaaa

SEQ ID NO: 3134 - DNA, 20 bp, Artificial sequence
  Synthetic oligonucleotide
atgtaattcttaaaaaaacc

SEQ ID NO: 3135 - DNA, 20 bp, Artificial sequence
  Synthetic oligonucleotide
gagataagactttttatgtt

SEQ ID NO: 3136 - DNA, 20 bp, Artificial sequence
  Synthetic oligonucleotide
gttctaaactatttatagac

SEQ ID NO: 3137 - DNA, 20 bp, Artificial sequence
  Synthetic oligonucleotide
tgaagaacattatgcaaaaa

SEQ ID NO: 3138 - DNA, 20 bp, Artificial sequence
  Synthetic oligonucleotide
actgactaaagcacccttgg

SEQ ID NO: 3139 - DNA, 20 bp, Artificial sequence
  Synthetic oligonucleotide
actacaagcaaacacaggca

SEQ ID NO: 3140 - DNA, 20 bp, Artificial sequence
  Synthetic oligonucleotide
tcccattgcattgttttaag

SEQ ID NO: 3141 - DNA, 20 bp, Artificial sequence
  Synthetic oligonucleotide
aatgacacttcataaccact

SEQ ID NO: 3142 - DNA, 20 bp, Artificial sequence
  Synthetic oligonucleotide
ggtgaaacttaagacttaaa

SEQ ID NO: 3143 - DNA, 20 bp, Artificial sequence
  Synthetic oligonucleotide
tacaacccctaaggaaataa

SEQ ID NO: 3144 - DNA, 20 bp, Artificial sequence
  Synthetic oligonucleotide
actttgttacttattacctt

SEQ ID NO: 3145 - DNA, 20 bp, Artificial sequence
  Synthetic oligonucleotide
tattattctcacatataaat

SEQ ID NO: 3146 - DNA, 20 bp, Artificial sequence
  Synthetic oligonucleotide
actacggtagttctcagaaa

SEQ ID NO: 3147 - DNA, 20 bp, Artificial sequence
  Synthetic oligonucleotide
tataaattcttaaataactc

SEQ ID NO: 3148 - DNA, 20 bp, Artificial sequence
  Synthetic oligonucleotide
ccagctcctagtgtcctttt

SEQ ID NO: 3149 - DNA, 20 bp, Artificial sequence
  Synthetic oligonucleotide
ggttgacatattagtaattt

SEQ ID NO: 3150 - DNA, 20 bp, Artificial sequence
  Synthetic oligonucleotide
caccccaaaataactcaaaa

SEQ ID NO: 3151 - DNA, 20 bp, Artificial sequence
  Synthetic oligonucleotide
gtgtgtttaatttgtaacta

SEQ ID NO: 3152 - DNA, 20 bp, Artificial sequence
  Synthetic oligonucleotide
gcaaacacagacatatgcag

SEQ ID NO: 3153 - DNA, 20 bp, Artificial sequence
  Synthetic oligonucleotide
ttccaaggtaagtgtgtagg

SEQ ID NO: 3154 - DNA, 20 bp, Artificial sequence
  Synthetic oligonucleotide
aacagagtgaggttttaggg

SEQ ID NO: 3155 - DNA, 20 bp, Artificial sequence
  Synthetic oligonucleotide
ctgtgtatttttcttcctca

SEQ ID NO: 3156 - DNA, 20 bp, Artificial sequence
  Synthetic oligonucleotide
gtctccttgttgtatggtaa

SEQ ID NO: 3157 - DNA, 20 bp, Artificial sequence
  Synthetic oligonucleotide
ctgatgtgttcatgactttc

SEQ ID NO: 3158 - DNA, 20 bp, Artificial sequence
  Synthetic oligonucleotide
cttgttacttcttttgctag

SEQ ID NO: 3159 - DNA, 20 bp, Artificial sequence
  Synthetic oligonucleotide
gcccgccccctgccaccagc

SEQ ID NO: 3160 - DNA, 20 bp, Artificial sequence
  Synthetic oligonucleotide
gtagtgtttgggatgcttca

SEQ ID NO: 3161 - DNA, 20 bp, Artificial sequence
  Synthetic oligonucleotide
gcaacttaataaccttagtt

SEQ ID NO: 3162 - DNA, 20 bp, Artificial sequence
  Synthetic oligonucleotide
ctacaaaataacatacacaa

SEQ ID NO: 3163 - DNA, 20 bp, Artificial sequence
  Synthetic oligonucleotide
cctagtcacattagaatgta

SEQ ID NO: 3164 - DNA, 20 bp, Artificial sequence
  Synthetic oligonucleotide
agcttagagtttttgccttc

SEQ ID NO: 3165 - DNA, 20 bp, Artificial sequence
  Synthetic oligonucleotide
acacagcatgatcttgtgta

SEQ ID NO: 3166 - DNA, 20 bp, Artificial sequence
  Synthetic oligonucleotide
cacaaagtccacagcaaatg

SEQ ID NO: 3167 - DNA, 20 bp, Artificial sequence
  Synthetic oligonucleotide
ttgaattacaatgcggtata

SEQ ID NO: 3168 - DNA, 20 bp, Artificial sequence
  Synthetic oligonucleotide
ggccagtatctcagtttttt

SEQ ID NO: 3169 - DNA, 20 bp, Artificial sequence
  Synthetic oligonucleotide
gtgcgcatcattacgaccat

SEQ ID NO: 3170 - DNA, 20 bp, Artificial sequence
  Synthetic oligonucleotide
tgtatttttactcacctttt

SEQ ID NO: 3171 - DNA, 20 bp, Artificial sequence
  Synthetic oligonucleotide
ctagtctatactaccacata

SEQ ID NO: 3172 - DNA, 20 bp, Artificial sequence
  Synthetic oligonucleotide
gactttgaaatctcacaagg

SEQ ID NO: 3173 - DNA, 20 bp, Artificial sequence
  Synthetic oligonucleotide
accggattgttttcttcatt

SEQ ID NO: 3174 - DNA, 20 bp, Artificial sequence
  Synthetic oligonucleotide
aagtcttgttcagtgtcctt

SEQ ID NO: 3175 - DNA, 20 bp, Artificial sequence
  Synthetic oligonucleotide
tcctcctctcttcatggcct

SEQ ID NO: 3176 - DNA, 20 bp, Artificial sequence
  Synthetic oligonucleotide
gaaatgaagatgaaaatagt

SEQ ID NO: 3177 - DNA, 20 bp, Artificial sequence
  Synthetic oligonucleotide
tttcagacttcttgttgttg

SEQ ID NO: 3178 - DNA, 20 bp, Artificial sequence
  Synthetic oligonucleotide
tttgttcttccaatttcaga

SEQ ID NO: 3179 - DNA, 20 bp, Artificial sequence
  Synthetic oligonucleotide
agaaaagattgtattttaca

SEQ ID NO: 3180 - DNA, 20 bp, Artificial sequence
  Synthetic oligonucleotide
gtatttactacttctgcatg

SEQ ID NO: 3181 - DNA, 20 bp, Artificial sequence
  Synthetic oligonucleotide
ggtcggcaagcagtgtcttt

SEQ ID NO: 3182 - DNA, 20 bp, Artificial sequence
  Synthetic oligonucleotide
ttatgagggactagagcatc

SEQ ID NO: 3183 - DNA, 20 bp, Artificial sequence
  Synthetic oligonucleotide
gtgtacttatagtctgtaca

SEQ ID NO: 3184 - DNA, 20 bp, Artificial sequence
  Synthetic oligonucleotide
gtacttttacaatgaattat

SEQ ID NO: 3185 - DNA, 20 bp, Artificial sequence
  Synthetic oligonucleotide
aaattaccttcggactgtaa

SEQ ID NO: 3186 - DNA, 20 bp, Artificial sequence
  Synthetic oligonucleotide
ctcatcaaggtaccagttct

SEQ ID NO: 3187 - DNA, 20 bp, Artificial sequence
  Synthetic oligonucleotide
ggacaagaaattttcagttg

SEQ ID NO: 3188 - DNA, 20 bp, Artificial sequence
  Synthetic oligonucleotide
acctgatgtcctaaacacat

SEQ ID NO: 3189 - DNA, 20 bp, Artificial sequence
  Synthetic oligonucleotide
agatacacgaatacagagcc

SEQ ID NO: 3190 - DNA, 20 bp, Artificial sequence
  Synthetic oligonucleotide
agagctcaaactgtaacagg

SEQ ID NO: 3191 - DNA, 20 bp, Artificial sequence
  Synthetic oligonucleotide
atgcagtacaacattccatt

SEQ ID NO: 3192 - DNA, 20 bp, Artificial sequence
  Synthetic oligonucleotide
aatctacttttatgtctcct

SEQ ID NO: 3193 - DNA, 20 bp, Artificial sequence
  Synthetic oligonucleotide
aaaccatccaagacaagaga

SEQ ID NO: 3194 - DNA, 20 bp, Artificial sequence
  Synthetic oligonucleotide
tctagtgagtataaaaatat

SEQ ID NO: 3195 - DNA, 20 bp, Artificial sequence
  Synthetic oligonucleotide
ctgagttctataggtgctta

SEQ ID NO: 3196 - DNA, 20 bp, Artificial sequence
  Synthetic oligonucleotide
ttaacatcagatttaacatc

SEQ ID NO: 3197 - DNA, 20 bp, Artificial sequence
  Synthetic oligonucleotide
actagaaatctgaccttatt

SEQ ID NO: 3198 - DNA, 20 bp, Artificial sequence
  Synthetic oligonucleotide
tatcaatccatcaaaaatat

SEQ ID NO: 3199 - DNA, 20 bp, Artificial sequence
  Synthetic oligonucleotide
tctgtatgttcctagtactt

SEQ ID NO: 3200 - DNA, 20 bp, Artificial sequence
  Synthetic oligonucleotide
gttaccaaattctcacagtt

SEQ ID NO: 3201 - DNA, 20 bp, Artificial sequence
  Synthetic oligonucleotide
tttttcatggctccaatatc

SEQ ID NO: 3202 - DNA, 20 bp, Artificial sequence
  Synthetic oligonucleotide
aagtattttaagtatttaga

SEQ ID NO: 3203 - DNA, 20 bp, Artificial sequence
  Synthetic oligonucleotide
gtgttgcacataggttagaa

SEQ ID NO: 3204 - DNA, 20 bp, Artificial sequence
  Synthetic oligonucleotide
tggagaaaagactcaatgaa

SEQ ID NO: 3205 - DNA, 20 bp, Artificial sequence
  Synthetic oligonucleotide
ttaagtatcatatatttctc

SEQ ID NO: 3206 - DNA, 20 bp, Artificial sequence
  Synthetic oligonucleotide
tttggaatcttattaagcaa

SEQ ID NO: 3207 - DNA, 20 bp, Artificial sequence
  Synthetic oligonucleotide
ggttccttacaattatctat

SEQ ID NO: 3208 - DNA, 20 bp, Artificial sequence
  Synthetic oligonucleotide
ggttaattaggatctataca

SEQ ID NO: 3209 - DNA, 20 bp, Artificial sequence
  Synthetic oligonucleotide
tacattttaaccctttgagg

SEQ ID NO: 3210 - DNA, 20 bp, Artificial sequence
  Synthetic oligonucleotide
taaaggataggcaaagacca

SEQ ID NO: 3211 - DNA, 20 bp, Artificial sequence
  Synthetic oligonucleotide
aggtttacagaaagttgtgc

SEQ ID NO: 3212 - DNA, 20 bp, Artificial sequence
  Synthetic oligonucleotide
tcctggtatgcccctatgga

SEQ ID NO: 3213 - DNA, 20 bp, Artificial sequence
  Synthetic oligonucleotide
ttactatgggttggacactt

SEQ ID NO: 3214 - DNA, 20 bp, Artificial sequence
  Synthetic oligonucleotide
ccagtgtctctgaagaacat

SEQ ID NO: 3215 - DNA, 20 bp, Artificial sequence
  Synthetic oligonucleotide
cccttgtgccttgaataaaa

SEQ ID NO: 3216 - DNA, 20 bp, Artificial sequence
  Synthetic oligonucleotide
tataatcacaactgatgggc

SEQ ID NO: 3217 - DNA, 20 bp, Artificial sequence
  Synthetic oligonucleotide
ttcccattgcattgttttaa

SEQ ID NO: 3218 - DNA, 20 bp, Artificial sequence
  Synthetic oligonucleotide
caaacaaaaaggaataagct

SEQ ID NO: 3219 - DNA, 20 bp, Artificial sequence
  Synthetic oligonucleotide
aagggctgccagaaacagtg

SEQ ID NO: 3220 - DNA, 20 bp, Artificial sequence
  Synthetic oligonucleotide
aaagaatgtcaccattttac

SEQ ID NO: 3221 - DNA, 20 bp, Artificial sequence
  Synthetic oligonucleotide
tactttgttacttattacct

SEQ ID NO: 3222 - DNA, 20 bp, Artificial sequence
  Synthetic oligonucleotide
ttattattctcacatataaa

SEQ ID NO: 3223 - DNA, 20 bp, Artificial sequence
  Synthetic oligonucleotide
tgaataaaccaaaattatcc

SEQ ID NO: 3224 - DNA, 20 bp, Artificial sequence
  Synthetic oligonucleotide
gataatgtggaaaattaaga

SEQ ID NO: 3225 - DNA, 20 bp, Artificial sequence
  Synthetic oligonucleotide
atagaacaaaacaattcttt

SEQ ID NO: 3226 - DNA, 20 bp, Artificial sequence
  Synthetic oligonucleotide
aaaggtaaattagccttttg

SEQ ID NO: 3227 - DNA, 20 bp, Artificial sequence
  Synthetic oligonucleotide
ccaaactactaacagagaca

SEQ ID NO: 3228 - DNA, 20 bp, Artificial sequence
  Synthetic oligonucleotide
taaccacattccagaactag

SEQ ID NO: 3229 - DNA, 20 bp, Artificial sequence
  Synthetic oligonucleotide
tatagttcccagccctctct

SEQ ID NO: 3230 - DNA, 20 bp, Artificial sequence
  Synthetic oligonucleotide
ccccggtagtcacttcggag

SEQ ID NO: 3231 - DNA, 20 bp, Artificial sequence
  Synthetic oligonucleotide
gggcacatggcaaatttgag

SEQ ID NO: 3232 - DNA, 18 bp, Artificial sequence
  Synthetic oligonucleotide
tgtacttttctcatgtgc

SEQ ID NO: 3233 - DNA, 18 bp, Artificial sequence
  Synthetic oligonucleotide
ggattctgtacttttctc

SEQ ID NO: 3234 - DNA, 20 bp, Artificial sequence
  Synthetic oligonucleotide
ctggattctgtacttttctc

SEQ ID NO: 3235 - DNA, 20 bp, Artificial sequence
  Synthetic oligonucleotide
tggattctgtacttttctca

SEQ ID NO: 3236 - DNA, 20 bp, Artificial sequence
  Synthetic oligonucleotide
gtacttcacatttggagccc

SEQ ID NO: 3237 - DNA, 20 bp, Artificial sequence
  Synthetic oligonucleotide
actggattctgtacttttct

SEQ ID NO: 3238 - DNA, 20 bp, Artificial sequence
  Synthetic oligonucleotide
ctccattatttcttcacgtt

SEQ ID NO: 3239 - DNA, 20 bp, Artificial sequence
  Synthetic oligonucleotide
tctccattatttcttcacgt

SEQ ID NO: 3240 - DNA, 18 bp, Artificial sequence
  Synthetic oligonucleotide
ttagagtttttgccttcc

SEQ ID NO: 3241 - DNA, 18 bp, Artificial sequence
  Synthetic oligonucleotide
cttagagtttttgccttc

SEQ ID NO: 3242 - DNA, 18 bp, Artificial sequence
  Synthetic oligonucleotide
gcttagagtttttgcctt

SEQ ID NO: 3243 - DNA, 18 bp, Artificial sequence
  Synthetic oligonucleotide
tatgtttgtctgtcttat

SEQ ID NO: 3244 - DNA, 18 bp, Artificial sequence
  Synthetic oligonucleotide
gtatgtttgtctgtctta

SEQ ID NO: 3245 - DNA, 18 bp, Artificial sequence
  Synthetic oligonucleotide
cgtatgtttgtctgtctt

SEQ ID NO: 3246 - DNA, 18 bp, Artificial sequence
  Synthetic oligonucleotide
tacttcacatttggagcc

SEQ ID NO: 3247 - DNA, 18 bp, Artificial sequence
  Synthetic oligonucleotide
gtacttcacatttggagc

SEQ ID NO: 3248 - DNA, 18 bp, Artificial sequence
  Synthetic oligonucleotide
tgtacttcacatttggag

SEQ ID NO: 3249 - DNA, 18 bp, Artificial sequence
  Synthetic oligonucleotide
ttttctcatgtgcggcat

SEQ ID NO: 3250 - DNA, 18 bp, Artificial sequence
  Synthetic oligonucleotide
cttttctcatgtgcggca

SEQ ID NO: 3251 - DNA, 18 bp, Artificial sequence
  Synthetic oligonucleotide
acttttctcatgtgcggc

SEQ ID NO: 3252 - DNA, 18 bp, Artificial sequence
  Synthetic oligonucleotide
tacttttctcatgtgcgg

SEQ ID NO: 3253 - DNA, 18 bp, Artificial sequence
  Synthetic oligonucleotide
gtacttttctcatgtgcg

SEQ ID NO: 3254 - DNA, 18 bp, Artificial sequence
  Synthetic oligonucleotide
ctgtacttttctcatgtg

SEQ ID NO: 3255 - DNA, 18 bp, Artificial sequence
  Synthetic oligonucleotide
tctgtacttttctcatgt

SEQ ID NO: 3256 - DNA, 18 bp, Artificial sequence
  Synthetic oligonucleotide
ttctgtacttttctcatg

SEQ ID NO: 3257 - DNA, 18 bp, Artificial sequence
  Synthetic oligonucleotide
attctgtacttttctcat

SEQ ID NO: 3258 - DNA, 18 bp, Artificial sequence
  Synthetic oligonucleotide
gattctgtacttttctca

SEQ ID NO: 3259 - DNA, 18 bp, Artificial sequence
  Synthetic oligonucleotide
tggattctgtacttttct

SEQ ID NO: 3260 - DNA, 18 bp, Artificial sequence
  Synthetic oligonucleotide
ctggattctgtacttttc

SEQ ID NO: 3261 - DNA, 18 bp, Artificial sequence
  Synthetic oligonucleotide
ctccattatttcttcacg

SEQ ID NO: 3262 - DNA, 18 bp, Artificial sequence
  Synthetic oligonucleotide
tctccattatttcttcac

SEQ ID NO: 3263 - DNA, 18 bp, Artificial sequence
  Synthetic oligonucleotide
ctctccattatttcttca

SEQ ID NO: 3264 - DNA, 18 bp, Artificial sequence
  Synthetic oligonucleotide
taactggtttgcccttgc

SEQ ID NO: 3265 - DNA, 18 bp, Artificial sequence
  Synthetic oligonucleotide
ctaactggtttgcccttg

SEQ ID NO: 3266 - DNA, 18 bp, Artificial sequence
  Synthetic oligonucleotide
gctaactggtttgccctt

SEQ ID NO: 3267 - DNA, 18 bp, Artificial sequence
  Synthetic oligonucleotide
tgctaactggtttgccct

SEQ ID NO: 3268 - DNA, 18 bp, Artificial sequence
  Synthetic oligonucleotide
ctgctaactggtttgccc

SEQ ID NO: 3269 - DNA, 18 bp, Artificial sequence
  Synthetic oligonucleotide
tctgctaactggtttgcc

SEQ ID NO: 3270 - DNA, 18 bp, Artificial sequence
  Synthetic oligonucleotide
ttctgctaactggtttgc

SEQ ID NO: 3271 - DNA, 18 bp, Artificial sequence
  Synthetic oligonucleotide
tcatcattttccagggcc

SEQ ID NO: 3272 - DNA, 18 bp, Artificial sequence
  Synthetic oligonucleotide
atcatcattttccagggc

SEQ ID NO: 3273 - DNA, 18 bp, Artificial sequence
  Synthetic oligonucleotide
tatcatcattttccaggg

SEQ ID NO: 3274 - DNA, 18 bp, Artificial sequence
  Synthetic oligonucleotide
ctatcatcattttccagg

SEQ ID NO: 3275 - DNA, 18 bp, Artificial sequence
  Synthetic oligonucleotide
cctatcatcattttccag

SEQ ID NO: 3276 - DNA, 18 bp, Artificial sequence
  Synthetic oligonucleotide
tcctatcatcattttcca

SEQ ID NO: 3277 - DNA, 18 bp, Artificial sequence
  Synthetic oligonucleotide
ctcctatcatcattttcc

SEQ ID NO: 3278 - DNA, 18 bp, Artificial sequence
  Synthetic oligonucleotide
ctatttctttgtccagga

SEQ ID NO: 3279 - DNA, 18 bp, Artificial sequence
  Synthetic oligonucleotide
tctatttctttgtccagg

SEQ ID NO: 3280 - DNA, 18 bp, Artificial sequence
  Synthetic oligonucleotide
ctctatttctttgtccag

SEQ ID NO: 3281 - DNA, 18 bp, Artificial sequence
  Synthetic oligonucleotide
tctctatttctttgtcca

SEQ ID NO: 3282 - DNA, 18 bp, Artificial sequence
  Synthetic oligonucleotide
ttctctatttctttgtcc

SEQ ID NO: 3283 - DNA, 18 bp, Artificial sequence
  Synthetic oligonucleotide
cttctctatttctttgtc

SEQ ID NO: 3284 - DNA, 18 bp, Artificial sequence
  Synthetic oligonucleotide
acttctctatttctttgt

SEQ ID NO: 3285 - DNA, 18 bp, Artificial sequence
  Synthetic oligonucleotide
gtggtgtgcgcatgtaga

SEQ ID NO: 3286 - DNA, 18 bp, Artificial sequence
  Synthetic oligonucleotide
ggtggtgtgcgcatgtag

SEQ ID NO: 3287 - DNA, 18 bp, Artificial sequence
  Synthetic oligonucleotide
tggtggtgtgcgcatgta

SEQ ID NO: 3288 - DNA, 18 bp, Artificial sequence
  Synthetic oligonucleotide
tactgtttcgacctctga

SEQ ID NO: 3289 - DNA, 18 bp, Artificial sequence
  Synthetic oligonucleotide
ttactgtttcgacctctg

SEQ ID NO: 3290 - DNA, 18 bp, Artificial sequence
  Synthetic oligonucleotide
gttactgtttcgacctct

SEQ ID NO: 3291 - DNA, 20 bp, Artificial sequence
  Synthetic oligonucleotide
gttactgtttcgacctctga

SEQ ID NO: 3292 - DNA, 18 bp, Artificial sequence
  Synthetic oligonucleotide
tgcctctactcggtccaa

SEQ ID NO: 3293 - DNA, 20 bp, Artificial sequence
  Synthetic oligonucleotide
gttactgtttcgacctcgga

SEQ ID NO: 3294 - DNA, 20 bp, Artificial sequence
  Synthetic oligonucleotide
gtatgtttgtctgtcttatt

SEQ ID NO: 3295 - DNA, 20 bp, Artificial sequence
  Synthetic oligonucleotide
tcgtatgtttgtctgtctta

SEQ ID NO: 3296 - DNA, 20 bp, Artificial sequence
  Synthetic oligonucleotide
acttcacatttggagcccta

SEQ ID NO: 3297 - DNA, 20 bp, Artificial sequence
  Synthetic oligonucleotide
tacttcacatttggagccct

SEQ ID NO: 3298 - DNA, 20 bp, Artificial sequence
  Synthetic oligonucleotide
attctgtacttttctcatgt

SEQ ID NO: 3299 - DNA, 20 bp, Artificial sequence
  Synthetic oligonucleotide
aactggattctgtacttttc

SEQ ID NO: 3300 - DNA, 20 bp, Artificial sequence
  Synthetic oligonucleotide
gaactggattctgtactttt

SEQ ID NO: 3301 - DNA, 20 bp, Artificial sequence
  Synthetic oligonucleotide
tccattatttcttcacgttt

SEQ ID NO: 3302 - DNA, 20 bp, Artificial sequence
  Synthetic oligonucleotide
ctctatttctttgtccagga

SEQ ID NO: 3303 - DNA, 20 bp, Artificial sequence
  Synthetic oligonucleotide
gtggtgtgcgcatgtagacc

SEQ ID NO: 3304 - DNA, 20 bp, Artificial sequence
  Synthetic oligonucleotide
ggtggtgtgcgcatgtagac

SEQ ID NO: 3305 - DNA, 20 bp, Artificial sequence
  Synthetic oligonucleotide
gtggtggtgtgcgcatgtag

SEQ ID NO: 3306 - DNA, 20 bp, Artificial sequence
  Synthetic oligonucleotide
cgtggtggtgtgcgcatgta

SEQ ID NO: 3307 - DNA, 20 bp, Artificial sequence
  Synthetic oligonucleotide
agttcacctgcatcccaggg

SEQ ID NO: 3308 - DNA, 20 bp, Artificial sequence
  Synthetic oligonucleotide
gagttcacctgcatcccagg

SEQ ID NO: 3309 - DNA, 20 bp, Artificial sequence
  Synthetic oligonucleotide
tgagttcacctgcatcccag

SEQ ID NO: 3310 - DNA, 20 bp, Artificial sequence
  Synthetic oligonucleotide
tgtgagttcacctgcatccc

SEQ ID NO: 3311 - DNA, 20 bp, Artificial sequence
  Synthetic oligonucleotide
ctgtgagttcacctgcatcc

SEQ ID NO: 3312 - DNA, 20 bp, Artificial sequence
  Synthetic oligonucleotide
gctgtgagttcacctgcatc

SEQ ID NO: 3313 - DNA, 20 bp, Artificial sequence
  Synthetic oligonucleotide
gcggtgaattctgtctccca

SEQ ID NO: 3314 - DNA, 20 bp, Artificial sequence
  Synthetic oligonucleotide
tacgcggtgaattctgtctc

SEQ ID NO: 3315 - DNA, 20 bp, Artificial sequence
  Synthetic oligonucleotide
catacgcggtgaattctgtc

SEQ ID NO: 3316 - DNA, 20 bp, Artificial sequence
  Synthetic oligonucleotide
actgtttcgacctctgaaaa

SEQ ID NO: 3317 - DNA, 20 bp, Artificial sequence
  Synthetic oligonucleotide
tactgtttcgacctctgaaa

SEQ ID NO: 3318 - DNA, 20 bp, Artificial sequence
  Synthetic oligonucleotide
ttactgtttcgacctctgaa

SEQ ID NO: 3319 - DNA, 20 bp, Artificial sequence
  Synthetic oligonucleotide
tgttactgtttcgacctctg

The invention claimed is:
1. A modified oligonucleotide according to the following formula:
(SEQ ID NO: 3235)
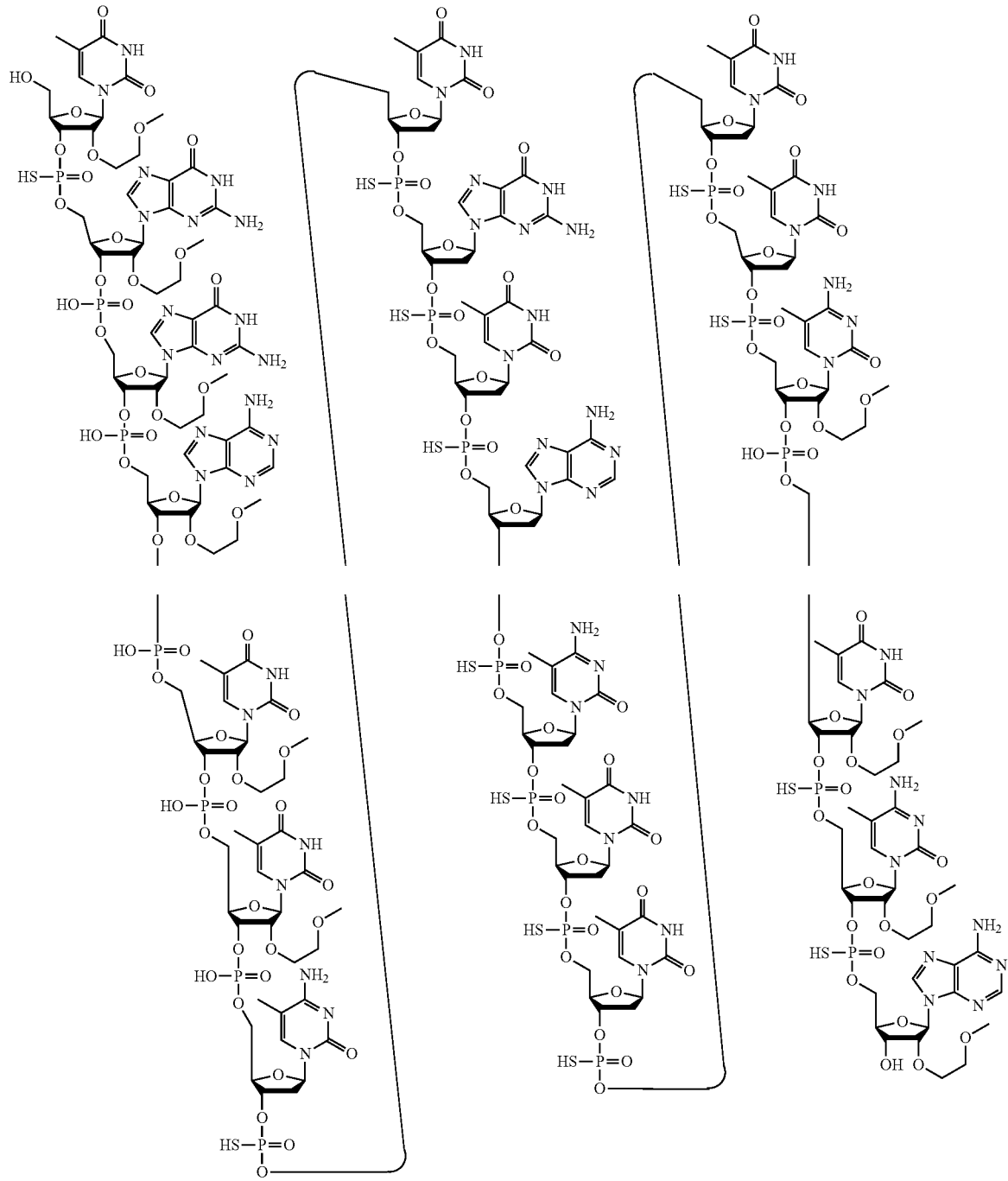
or a salt thereof.
2. The modified oligonucleotide of claim 1, which is a sodium salt or a potassium salt of the formula.
3. A modified oligonucleotide according to the following formula:

SEQ ID NO: 3235

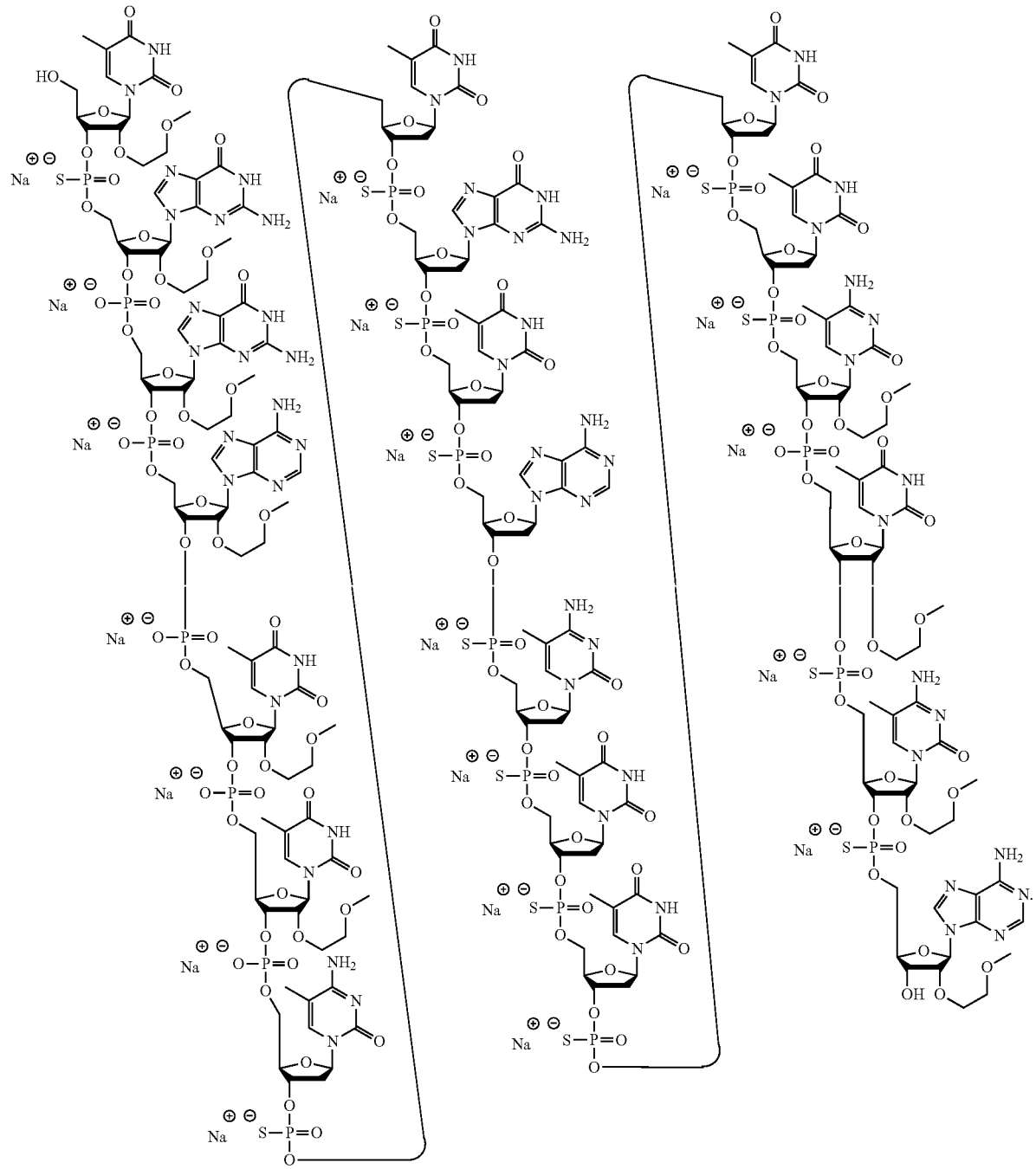

4. A chirally enriched population of modified oligonucleotides of claim 1, wherein the population is enriched for modified oligonucleotides comprising at least one particular phosphorothioate internucleoside linkage having a particular stereochemical configuration.

5. The chirally enriched population of claim 4, wherein the population is enriched for modified oligonucleotides comprising at least one particular phosphorothioate internucleoside linkage having the (Sp) configuration.

6. The chirally enriched population of claim 4, wherein the population is enriched for modified oligonucleotides comprising at least one particular phosphorothioate internucleoside linkage having the (Rp) configuration.

7. The chirally enriched population of claim 4, wherein the population is enriched for modified oligonucleotides having a particular, independently selected stereochemical configuration at each phosphorothioate internucleoside linkage.

8. The chirally enriched population of claim 7, wherein the population is enriched for modified oligonucleotides having the (Sp) configuration at each phosphorothioate internucleoside linkage.

9. The chirally enriched population of claim 7, wherein the population is enriched for modified oligonucleotides having the (Rp) configuration at each phosphorothioate internucleoside linkage.

10. The chirally enriched population of claim 4, wherein the population is enriched for modified oligonucleotides having at least 3 contiguous phosphorothioate internucleoside linkages in the Sp-Sp-Rp configuration, in the 5' to 3' direction.

11. A population of modified oligonucleotides of claim 1, wherein all of the phosphorothioate internucleoside linkages of the modified oligonucleotide are stereorandom.

12. A pharmaceutical composition comprising the modified oligonucleotide of claim 1, and a pharmaceutically acceptable diluent or carrier.

13. The pharmaceutical composition of claim 12, comprising a pharmaceutically acceptable diluent, wherein the pharmaceutically acceptable diluent is phosphate-buffered saline (PBS) or artificial cerebrospinal fluid (aCSF).

14. The pharmaceutical composition of claim 12, wherein the pharmaceutical composition consists essentially of the modified oligonucleotide and phosphate-buffered saline (PBS) or artificial cerebrospinal fluid (aCSF).

15. An oligomeric compound comprising a modified oligonucleotide according to the following formula:

$T_{es}G_{eo}G_{eo}A_{eo}T_{eo}T_{eo}{}^mC_{ds}T_{ds}G_{ds}T_{ds}A_{ds}{}^mC_{ds}T_{ds}T_{ds}T_{ds}T_{ds}{}^mC_{eo}T_{es}{}^mC_{es}A_e$ (SEQ ID NO: 3235);

wherein,
A=an adenine nucleobase,
$^mC$=a 5'-methyl cytosine nucleobase,
G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.

16. A pharmaceutical composition comprising the chirally enriched population of modified oligonucleotides of claim 4, and a pharmaceutically acceptable diluent or carrier.

17. The oligomeric compound of claim 15, wherein the modified oligonucleotide is covalently linked to a conjugate group.

18. An oligomeric duplex comprising the modified oligonucleotide of claim 1.

19. An oligomeric duplex comprising the oligomeric compound of claim 15.

20. A pharmaceutical composition comprising the oligomeric compound of claim 15 and a pharmaceutically acceptable carrier or diluent.

21. The pharmaceutical composition of claim 20, comprising a pharmaceutically acceptable diluent, wherein the pharmaceutically acceptable diluent is phosphate-buffered saline (PBS) or artificial cerebrospinal fluid (aCSF).

22. The pharmaceutical composition of claim 20, wherein the pharmaceutical composition consists essentially of the oligomeric compound and phosphate-buffered saline (PBS) or artificial cerebrospinal fluid (aCSF).

23. A pharmaceutical composition comprising the oligomeric compound of claim 17 and a pharmaceutically acceptable carrier or diluent.

24. The pharmaceutical composition of claim 23, comprising a pharmaceutically acceptable diluent, wherein the pharmaceutically acceptable diluent is phosphate-buffered saline (PBS) or artificial cerebrospinal fluid (aCSF).

25. The pharmaceutical composition of claim 23, wherein the pharmaceutical composition consists essentially of the oligomeric compound and phosphate-buffered saline (PBS) or artificial cerebrospinal fluid (aCSF).

26. The chirally enriched population of claim 7, wherein the population is enriched for modified oligonucleotides having the (Rp) configuration at one particular phosphorothioate internucleoside linkage and the (Sp) configuration at each of the remaining phosphorothioate internucleoside linkages.

27. The modified oligonucleotide of claim 1, which is a potassium salt of the formula.

28. A pharmaceutical composition comprising the modified oligonucleotide of claim 3 and a pharmaceutically acceptable carrier or diluent.

29. The pharmaceutical composition of claim 28, comprising a pharmaceutically acceptable diluent, wherein the pharmaceutically acceptable diluent is phosphate-buffered saline (PBS) or artificial cerebrospinal fluid (aCSF).

30. The pharmaceutical composition of claim 28, wherein the pharmaceutical composition consists essentially of the modified oligonucleotide and phosphate-buffered saline (PBC) or artificial cerebrospinal fluid (aCSF).

31. A pharmaceutical composition comprising the modified oligonucleotide of claim 27 and a pharmaceutically acceptable carrier or diluent.

32. The pharmaceutical composition of claim 31, comprising a pharmaceutically acceptable diluent, wherein the pharmaceutically acceptable diluent is phosphate-buffered saline (PBS) or artificial cerebrospinal fluid (aCSF).

33. The pharmaceutical composition of claim 31, wherein the pharmaceutical composition consists essentially of the oligomeric compound and phosphate-buffered saline (PBS) or artificial cerebrospinal fluid (aCSF).

34. A pharmaceutical composition comprising the oligomeric duplex of claim 18 and a pharmaceutically acceptable carrier or diluent.

35. The pharmaceutical composition of claim 34, comprising a pharmaceutically acceptable diluent, wherein the pharmaceutically acceptable diluent is phosphate-buffered saline (PBS) or artificial cerebrospinal fluid (aCSF).

36. The pharmaceutical composition of claim 34, wherein the pharmaceutical composition consists essentially of the oligomeric duplex and phosphate-buffered saline (PBS) or artificial cerebrospinal fluid (aCSF).

* * * * *

UNITED STATES PATENT AND TRADEMARK OFFICE
CERTIFICATE OF CORRECTION

PATENT NO. : 11,078,486 B2
APPLICATION NO. : 16/522133
DATED : August 3, 2021
INVENTOR(S) : Susan M. Freier et al.

It is certified that error appears in the above-identified patent and that said Letters Patent is hereby corrected as shown below:

In the Specification

Column 38, Line 21, should read: -- mC=a 5-methyl cytosine nucleobase, --

Column 38, Line 37, should read: -- mC=a 5-methyl cytosine nucleobase, --

Column 38, Line 52, should read: -- mC=a 5-methyl cytosine nucleobase, --

Column 38, Line 67, should read: -- mC=a 5-methyl cytosine nucleobase, --

Column 39, Line 15, should read: -- mC=a 5-methyl cytosine nucleobase, --

Column 39, Line 30, should read: -- mC=a 5-methyl cytosine nucleobase, --

Signed and Sealed this
Twenty-eighth Day of December, 2021

Drew Hirshfeld
*Performing the Functions and Duties of the*
*Under Secretary of Commerce for Intellectual Property and*
*Director of the United States Patent and Trademark Office*

CERTIFICATE OF CORRECTION (continued)
U.S. Pat. No. 11,078,486 B2

Page 2 of 3

In the Claims

Claim 1, Columns 335-336, the structure should read as follows:

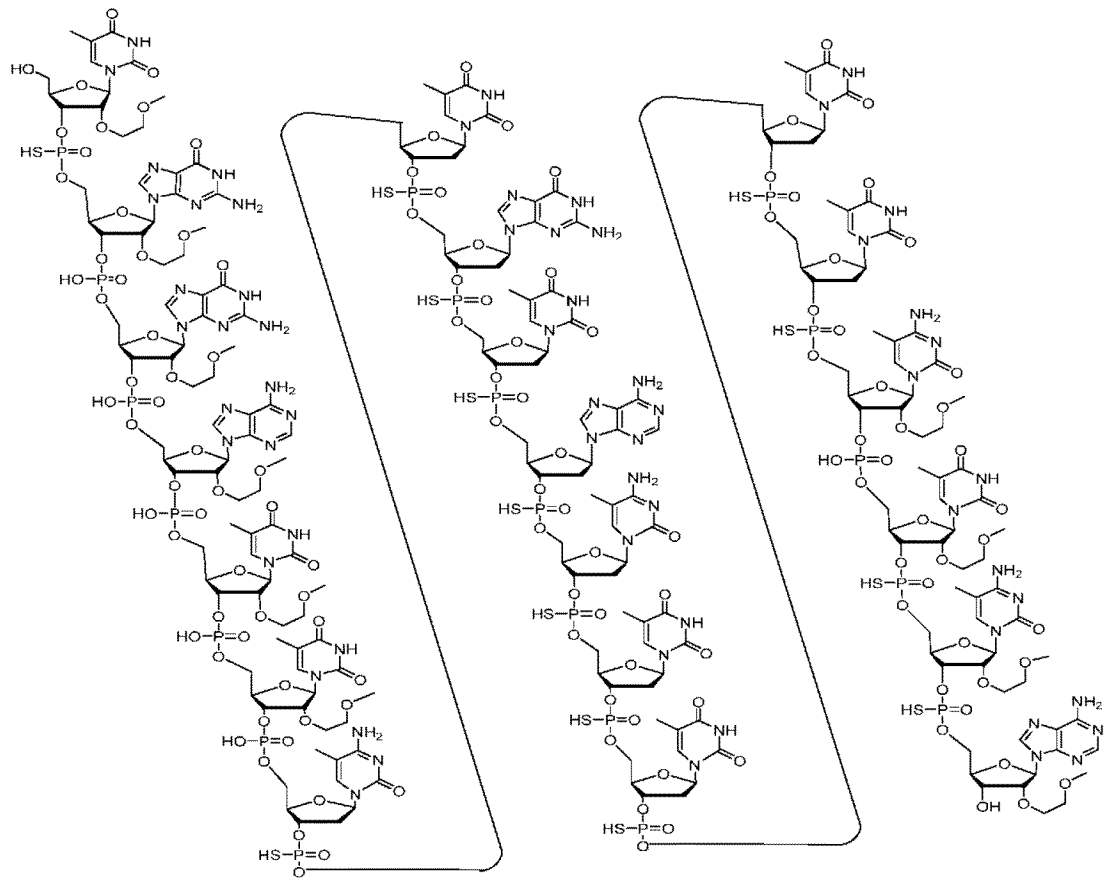

--                                                                                   --

Claim 3, Columns 337-338, the structure should read as follows:
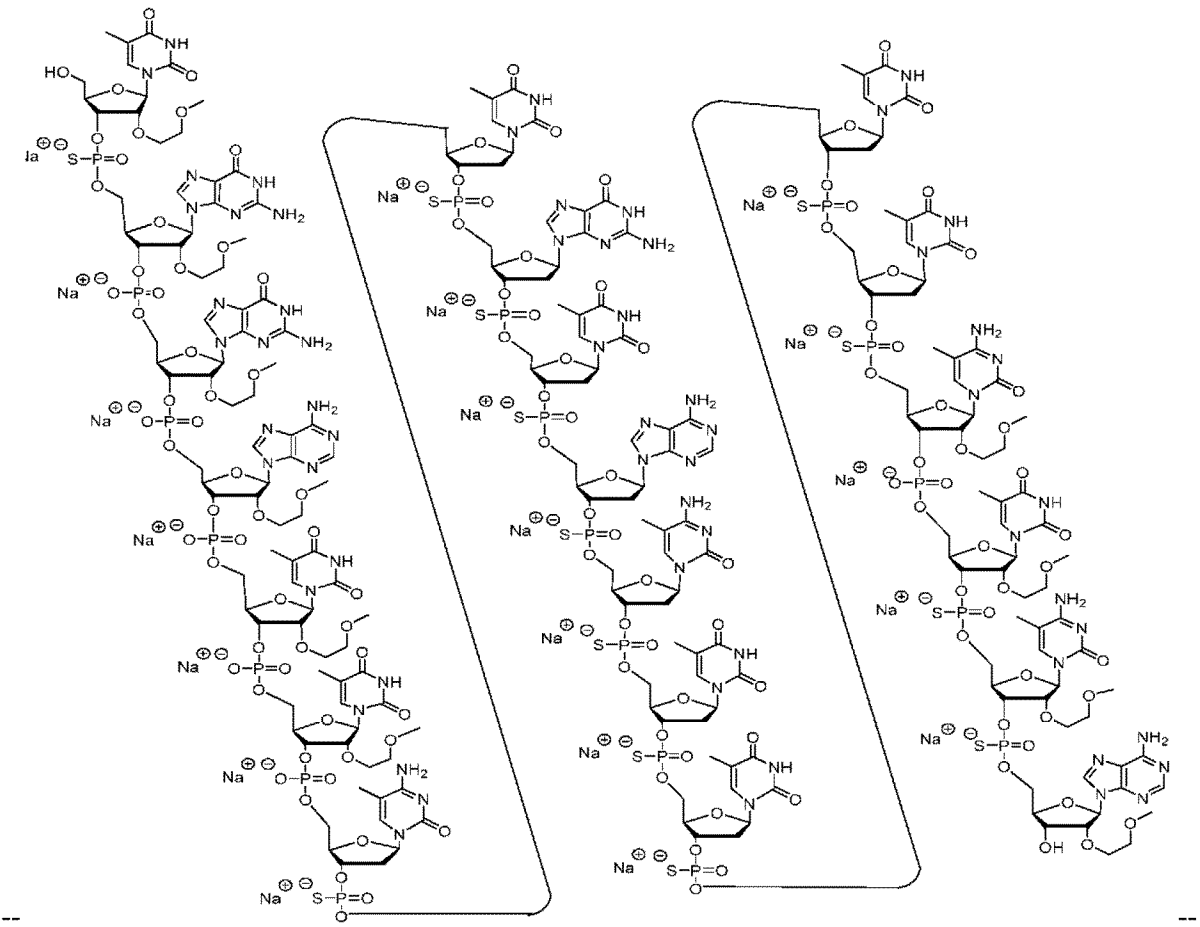
--
Claim 15, Column 339, Lines 26-27, should read:
-- $T_{es}G_{eo}G_{eo}A_{eo}T_{eo}T_{e}o^{m}C_{ds}T_{ds}G_{ds}T_{ds}A_{ds}{}^{m}C_{ds}T_{ds}T_{ds}T_{ds}T_{ds}{}^{m}C_{eo}T_{es}{}^{m}C_{es}A_{e}$ (SEQ ID NO: 3235); --
Claim 15, Column 339, Line 30, should read: -- mC=a 5-methyl cytosine nucleobase, --
Claim 30, Column 340, Line 32, should read: -- (PBS) or artificial cerebrospinal fluid (aCSF). --